US008101393B2

(12) United States Patent
Gray et al.

(10) Patent No.: US 8,101,393 B2
(45) Date of Patent: Jan. 24, 2012

(54) CELLULOLYTIC ENZYMES, NUCLEIC ACIDS ENCODING THEM AND METHODS FOR MAKING AND USING THEM

(75) Inventors: Kevin A. Gray, San Diego, CA (US); Lishan Zhao, Emeryville, CA (US); Michelle H. Cayouette, San Diego, CA (US)

(73) Assignee: BP Corporation North America Inc., Houston, TX (US)

( * ) Notice: Subject to any disclaimer, the term of this patent is extended or adjusted under 35 U.S.C. 154(b) by 165 days.

(21) Appl. No.: 12/278,958

(22) PCT Filed: Dec. 8, 2006

(86) PCT No.: PCT/US2006/046919
§ 371 (c)(1),
(2), (4) Date: Apr. 29, 2009

(87) PCT Pub. No.: WO2007/094852
PCT Pub. Date: Aug. 23, 2007

(65) Prior Publication Data
US 2009/0220480 A1 Sep. 3, 2009

Related U.S. Application Data

(60) Provisional application No. 60/772,786, filed on Feb. 10, 2006.

(51) Int. Cl.
*C12N 9/42* (2006.01)
*C12N 15/00* (2006.01)
*C12P 7/10* (2006.01)
*C12P 21/06* (2006.01)
*C07H 21/04* (2006.01)
*C07H 5/06* (2006.01)
*C07K 1/00* (2006.01)
*A61K 38/47* (2006.01)
*A23L 2/00* (2006.01)
*A23L 1/202* (2006.01)
*A23L 1/30* (2006.01)

(52) U.S. Cl. .... 435/209; 435/165; 435/69.1; 435/320.1; 536/23.2; 536/55.3; 530/350; 424/94.61; 426/590; 426/64; 426/648

(58) Field of Classification Search .................. 435/209, 435/165, 69.1, 320.1; 536/23.2, 55.3; 530/350; 424/94.61; 426/590, 64, 648
See application file for complete search history.

(56) References Cited

U.S. PATENT DOCUMENTS

| | | | |
|---|---|---|---|
| 4,788,066 A | 11/1988 | Witt | |
| 5,582,681 A | 12/1996 | Back | |
| 5,705,369 A | 1/1998 | Torget | |
| 5,709,796 A | 1/1998 | Fuqua | |
| 5,747,320 A | 5/1998 | Saha | |
| 5,795,766 A | 8/1998 | Suzuki | |
| 5,833,857 A | 11/1998 | Roth | |
| 5,958,758 A | 9/1999 | Miller | |
| 5,973,228 A | 10/1999 | Carlson | |
| 6,022,725 A | 2/2000 | Fowler | |
| 6,066,233 A | 5/2000 | Olsen | |
| 6,077,316 A | 6/2000 | Lund | |
| 6,087,131 A | 7/2000 | Gunata | |
| 6,090,595 A | 7/2000 | Foody | |
| 6,127,160 A | 10/2000 | Yamanobe | |
| 6,184,018 B1 | 2/2001 | Li | |
| 6,241,849 B1 | 6/2001 | Franks | |
| 6,251,643 B1 | 6/2001 | Hansen | |
| 6,409,841 B1 | 6/2002 | Lombard | |
| 6,423,145 B1 | 7/2002 | Nguyen | |
| 6,423,524 B1 | 7/2002 | Hagen | |
| 6,566,113 B1 | 5/2003 | Takayama | |
| 6,602,700 B1 | 8/2003 | Li | |
| 6,660,506 B2 | 12/2003 | Nguyen | |
| 6,921,655 B1 | 7/2005 | Nakamura | |
| 6,979,733 B2 | 12/2005 | Zhao | |
| 7,129,069 B2 | 10/2006 | Borchert | |
| 7,220,542 B2 | 5/2007 | Van Den Brink | |
| 7,393,673 B2 | 7/2008 | Adney | |
| 7,449,550 B2 * | 11/2008 | Adney et al. .................. 530/350 |
| 2003/0233675 A1 | 12/2003 | Cao | |
| 2006/0147581 A1 | 7/2006 | Svendsen | |
| 2006/0257984 A1 | 11/2006 | Borchert | |
| 2010/0189706 A1 * | 7/2010 | Chang et al. ................. 424/94.4 |

FOREIGN PATENT DOCUMENTS

RU  2127760  3/1999

(Continued)

OTHER PUBLICATIONS

Alcocer et al., Comparison of modular and non-modular xylanases as carrier proteins for the efficient secretion of heterologous proteins from Penicillium funiculosum. Appl Microbiol Biotechnol., 2003, vol. 60: 726-732.*

(Continued)

*Primary Examiner* — Ganapathirama Raghu
(74) *Attorney, Agent, or Firm* — Kalim S. Fuzail

(57) ABSTRACT

The invention provides polypeptides having any cellulolytic activity, e.g., a cellulase activity, a endoglucanase, a cellobiohydrolase, a beta-glucosidase, a xylanase, a mannanse, a β-xylosidase, an arabinofuranosidase, and/or an oligomerase activity, polynucleotides encoding these polypeptides, and methods of making and using these polynucleotides and polypeptides. In one aspect, the invention is directed to polypeptides having any cellulolytic activity, e.g., a cellulase activity, e.g., endoglucanase, cellobiohydrolase, beta-glucosidase, xylanase, mannanse, β-xylosidase, arabinofuranosidase, and/or oligomerase activity, including thermostable and thermotolerant activity, and polynucleotides encoding these enzymes, and making and using these polynucleotides and polypeptides. In one aspect, the invention provides polypeptides having an oligomerase activity, e.g., enzymes that convert recalcitrant soluble oligomers to fermentable sugars in the saccharification of biomass. The polypeptides of the invention can be used in a variety of pharmaceutical, agricultural, food and feed processing and industrial contexts. The invention also provides compositions or products of manufacture comprising mixtures of enzymes comprising at least one enzyme of this invention.

6 Claims, 123 Drawing Sheets

FOREIGN PATENT DOCUMENTS

| | | |
|---|---|---|
| WO | WO 99/57325 | 11/1999 |
| WO | WO 01/70998 | 9/2001 |
| WO | WO 02/24882 | 3/2002 |
| WO | WO 02/099091 | 12/2002 |
| WO | WO 03/000941 | 1/2003 |
| WO | WO 03/012109 | 2/2003 |
| WO | WO 03/093420 | 11/2003 |
| WO | WO 2004/016760 | 2/2004 |
| WO | WO 2004/078919 | 9/2004 |
| WO | WO 2004/081185 | 9/2004 |
| WO | WO 2005/003319 | 1/2005 |
| WO | WO 2006/101584 | 9/2006 |

OTHER PUBLICATIONS

Broun et al., Catalytic plasticity of fatty acid modification enzymes underlying chemical diversity of plant lipids. Science, 1998, vol. 282: 1315-1317.*
Devos et al., Practical limits of function prediction. Proteins: Structure, Function, and Genetics. 2000, vol. 41: 98-107.*
Guo et al., Protein tolerance to random amino acid change. PNAS., 2004, vol. 101 (25): 9205-9210.*
Sen et al., Developments in directed evolution for improving enzyme functions. Appl. Biochem. Biotechnol., 2007, vol. 143: 212-223.*
Whisstock et al., Prediction of protein function from protein sequence. Q. Rev. Biophysics., 2003, vol. 36 (3): 307-340.*
Poole—Mol Gen Genet (1990)—223—217-223.
USPTO—May 11, 2010—Office Action—U.S. Appl. No. 10/560,957.
Chica—Curr. Opin. Biotechnol. (2005)—16—378-384.
Witkowski—Biochemistry (1999)—38—11643-11650.
Seffernick—J. Bacteriol. (2001)—183—2405-2410.
JPO—May 10, 2010—Office Action—2006-518822.
Genbank Accession No. AAB42155 (Dec. 15, 2003).
Genbank Accession No. AAB61461 (Jan. 27, 2000).
Genbank Accession No. BAA74515 (May 5, 2010).
Wang—Molecular Genetics and Metabolism (1990)—222—265-269.
EA201000255—EAPO Search Report—May 5, 2010.
EP06845040—Supplementary EP Search Report—Jul. 14, 2009.
EMBL Accession No. AY690482 (Aug. 23, 2004)—*Penicillium occitanis* cellobiohydrolase I gene.
UNIPROT Accession No. Q68HC2 (Oct. 11, 2004)—Cellobiohydrolase.
GENESEQ Accession No. AAF85588 (Jun. 25, 2001)—*Acremonium cellulolyticus* cellbiohydrolase1.
GENESEQ Accession No. AAB81926 (Jun. 25, 2001)—*Acremonium cellulolyticus* cellobiohydrolase1.
Demain—Microbiology and Molecular Biology Reviews (2005)—69—124-154.
Lin—Applied Microbiology and Biotechnology (2006)—69—627-642.
Lynd—Current Opinion in Biotechnology (2005)—16—577-583.
Doi—Chemical Record (2001)—1—24-32.
CIPO—Jan. 12, 2010—First Office Action—2,529,403.
PCT/US2006/046919—ISR & WO—Apr. 8, 2008.
Altschul—Journal of Molecular Biology (1990)—215—403-410.
Lynd—Microbiol. And Molecular Biol. Reviews (2002)—66 -506-577.
Kikuchi—Science (2003)—301—376-379.
Sposato—Mol. Plant. Microbe Interact. (1995)—8—602-609.
Guttman—Anal. Biochem. (1996)—233 -234-242.
Coutinho—Recent Advances in Carbohydrate Bioeng. (1999)—3-12.
Charnock—J. Biol. Chem. (1998)—273—32187-32199.
Leibovitz—J. Bacteriol. (1996)—178—3077-3084.
Leibovitz—J. Bacteriol.(1997)—179—2519-2523.
Zhang—Biotechnology and Bioengineering (2004)—88—797-824.
Wood—Methods in Enzymology (1988)—160—87-116.
Shallom—Current Opinion in Microbiology (2003)—6—219-228.
Saha—J. Ind. Microbiol Biotechnol (2003)—30—279-291.
Parry—Archives of Biochemistry and Biophysics (2002)—404—243-253.
Murashima—Journal of Bacteriology (2003)—185—1518-1524.
Medv—Biotechnology and Bioengineering—(1998)—59—621-634.
Klyosov—Biochemistry (1990)—29—10577-10585.
Johnston—Journal of Food Biochemistry (1998)—22—301-319.
Irwin—Journal of Bacteriology (1998)—180—1709-1714.
Irwin—Biotechnology and Bioengineering (1993)—42—1002-1013.
Baker—Applied Biochemistry and Biotechnology (1994)—45-46—245-256.
Huang—Anal. Biochem. (1976)—2—369-377.
Canevascini—Anal. Biochem. (1985)—2—419-27.
Carder—Anal. Biochem. (1986)—1 -75-79.
Sharrock—J. Biochem. Biophys. Methods (1988)—2—81-105.
Baker—J. Biochem. Biophys Methods (1991)—4—265-273.
Zverlov—Microbiology (2002)—148—247-255.
Himmel—Curr. Opin. Biotechnol (1999)—10—358-364.
Harjunpaa—Eur. J. Biochem (1996)—240—584-591.
Varrot—Biochem J. (1999)—337—297-304.
Sakon—Nat. Struc. Biol. (1997)—4—810-818.
Mackenzie—Biochem J. (1998)—335—409-416.
Liebl—Mol. Gen. Genet. (1994)—242—111-115.
Grabnitz—Eur.J.Biochem (1991)—200—301-309.
Coutinho —The modular structure of cellulases and other carbohydrate-active enzymes: an integrated database approach. In "*Genetics, Biochemistry and Ecology of Cellulose Degradation*"(1999) K. Ohmiya, et al., eds., Uni Publishers Co., Tokyo, pp. 15-23.
Benhar, I. Biotechnological applications of phage and cell display. Biotechnology Advances 19, 1-13. 2001.
Coutinho, P. M. and Henrissat, B. Carbohydrate-Active Enzymes server at URL: http://afmb.cnrs-mrs.fr~cazy/CAZY/index.html. 1999.
Felix, C. R. and L. G. Ljungdahl. 1993. The cellulosome: the exocellular organelle of Clostridium. Annu. Rev. Microbiol 47:791-819.: 791-819.
Gray, K. A., T. H. Richardson, K. Kretz, J. M. Short, F. Bartnek, Knowles R., L. Kan, Swanson P.E., and Robertson D.E. 2001. Rapid evolution of reversible denaturation and elevated melting temperature in a microbial haloalkane dehalogenase. Advanced Synthesis and Catalysis 343:607-617.
Guttman, A., F. T. Chen, R. A. Evangelista, and N. Cooke. 1996. High-resolution capillary gel electrophoresis of reducing oligosaccharides labeled with 1-aminopyrene-3,6,8-trisulfonate. Anal. Biochem 233:234-242.
Harjunpaa, V., A. Teleman, A. Koivula, L. Ruohonen, T. T. Teeri, O. Teleman, and T. Drakenberg. 1996. Cello-oligosaccharide hydrolysis by cellobiohydrolase II from *Trichoderma reesei*. Association and rate constants derived from an analysis of progress curves. Eur. J Biochem 240:584-591.
Himmel, M. E., M. F. Ruth, and C. E. Wyman. 1999. Cellulase for commodity products from cellulosic biomass. Curr. Opin. Biotechnol 10:358-364.
Kerr, R. A. 1998. Geology:The Next Oil Crisis Looms Large—and Perhaps Close. Science 281:1128.
Kerr, R. A. 2000. Oil Outlook:USGS Optimistic on World Oil Prospects. Science 289:237.
King, R. W., K. D. Lustig, P. T. Stukenberg, T. J. McGarry, and M. W. Kirschner. 1997. Expression cloning in the test tube. Science 277:973-974.
Kuritz, T. 1999. An easy colorimetric assay for screening and qualitative assessment of deiodination and dehalogenation by bacterial cultures. Lett. Appl Microbiol 28:445-447.
Lundberg, K. S., P. L. Kretz, G. S. Provost, and J. M. Short. 1993. The use of selection in recovery of transgenic targets for mutation analysis. Mutat. Res. 301:99-105.
MacKenzie, L. F., G. Sulzenbacher, C. Divne, T. A. Jones, H. F. Woldike, M. Schulein, S. G. Withers, and G. J. Davies. 1998. Crystal structure of the family 7 endoglucanase I (Cel7B) from Humicola insolens at 2.2 A resolution and identification of the catalytic nucleophile by trapping of the covalent glycosyl-enzyme intermediate. Biochem J 335:409-416.
Richardson, T. H., X. Tan, G. Frey, W. Callen, M. Cabell, D. Lam, J. Macomber, J. M. Short, D. E. Robertson, and C. Miller. 2002. A novel, high performance enzyme for starch liquefaction. Discovery and optimization of a low pH, thermostable alpha-amylase. J Biol Chem 277:26501-26507.

Sakon, J., D. Irwin, D. B. Wilson, and P. A. Karplus. 1997. Structure and mechanism of endo/exocellulase E4 from Thermomonospora fusca. Nat. Struct. Biol 4:810-818.

Short, J. M., J. M. Fernandez, J. A. Sorge, and W. D. Huse. 1988. Lambda ZAP: a bacteriophage lambda expression vector with in vivo excision properties. Nucleic Acids Res. 16:7583-7600.

Snustad, D. P., J. P. Hunsperger, B. M. Chereskin, and J. Messing. 1988. Maize glutamine synthetase cDNAs: isolation by direct genetic selection in *Escherichia coli*. Genetics 120:1111-1123.

Varrot, A., S. Hastrup, M. Schulein, and G. J. Davies. 1999. Crystal structure of the catalytic core domain of the family 6 cellobiohydrolase II, Cel6A, from Humicola insolens, at 1.92 A resolution. Biochem J 337:297-304.

Yano, T., S. Oue, and H. Kagamiyama. 1998. Directed evolution of an aspartate aminotransferase with new substrate specificities. Proc. Natl. Acad. Sci U. S. A 95:5511-5515.

Zverlov, V. V., G. A. Velikodvorskaya, and W. H. Schwarz. 2002. A newly described cellulosomal cellobiohydrolase, CelO, from Clostridium thermocellum: investigation of the exo-mode of hydrolysis, and binding capacity to crystalline cellulose. Microbiology 148:247-255.

EP06733858.2—EP Supplementary Search Report—Nov. 6, 2009.
GENESEQ Accession No. ADQ79701 Thermus filiformis—CHO (2004).
UNIPROT Accession No. Q08638—Beta Glucosidase (1994).
UNIPROT Accession No. Q82M59—Streptomyces avermitilis (2003).
EP07875173—Supplemental EP Search Report—Nov. 12, 2009.
UNIPROT Accession No. O9X273—Endoglucanase—Nov. 1, 1999.
Gunnarsson—Protein Engineering Design and Selection (2004)—17(3)—213-221.
Tomme—FEBS Lett (1989)—243—239-243.
Gilkes—J. Biol. Chem. ( 988)—263—10401-10407.
Tomme—Enzymatic Degradation of insoluble Polysaccharides (.1995, Saddler, J.N. & Penner, M., eds.)—142-163.
Henrissat—Cum Op, Struct, Biol. (1997)—7-637-644.
Coutinho—J. Mol. Biol. (2003)—328-307-317.
Boraston — Biochem. J. (2004) — 382 — 769-781.
Jager—World Journal of Microbiology and Biotechnology—28—5—455-461, vol . 17, 2001.
Gunnarsson—Glycobiology (2006)—16—1171-1180.
Murashima—Jornal of Bacteriology (2005)—187—20—7146-7149.
Pages—Journal of Bacteriology (1996)—178—8—2279-2286.
Kakiuchi—Journal of Bacteriology (1998)—180—16—4303-4308.
Genbank Accession No. P23660—Endoglucanase (1991).
PCT/US2004/021492—ISR & WO—Jul. 25, 2008.
EP04777548—Supplementary EP Search Report—Apr. 27, 2009.

* cited by examiner

FIG. 5 Structure of Cellobiose

FIG. 14

| Screening using the GigaMatrix™ Platform vs. 384-well plates | | |
|---|---|---|
| | GigaMatrix™ | 384-Well Plates |
| Throughput (clone · assays/day) | $10^8$ to $10^9$ | $10^5$ |
| Automated 100,000 Sample Screen | 1 Plate | 261 Plates |
| Total Assay Equipment Time | <10 minutes | 30 hours |

FIG. 21

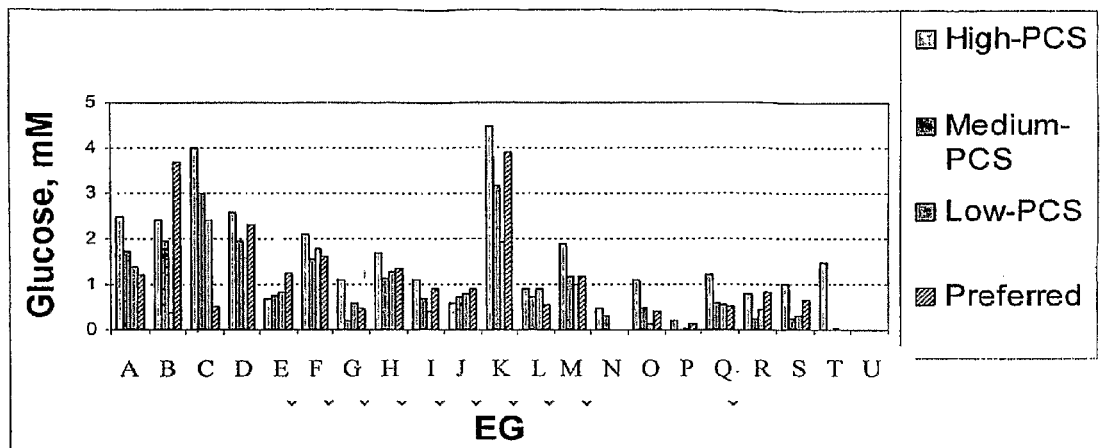

| Treatment | Enzyme |
|---|---|
| A | SEQ ID NO:152(encoded by SEQ ID NO:151) |
| B | SEQ ID NO:202(encoded by SEQ ID NO:201) |
| C | SEQ ID NO:196(encoded by SEQ ID NO:195) |
| D | SEQ ID NO:154(encoded by SEQ ID NO:153) |
| E | SEQ ID NO:302(encoded by SEQ ID NO:301) |
| F | SEQ ID NO:186(encoded by SEQ ID NO:185) |
| G | SEQ ID NO:308(encoded by SEQ ID NO:307) |
| H | SEQ ID NO:116(encoded by SEQ ID NO:115) |
| I | SEQ ID NO:240(encoded by SEQ ID NO:239) |
| J | SEQ ID NO:160(encoded by SEQ ID NO:159) |
| K | SEQ ID NO:106(encoded by SEQ ID NO:105) |
| L | SEQ ID NO:146(encoded by SEQ ID NO:145) |
| M | SEQ ID NO:256(encoded by SEQ ID NO:255) |
| N | SEQ ID NO:238(encoded by SEQ ID NO:237) |
| O | SEQ ID NO:416(encoded by SEQ ID NO:415) |
| P | SEQ ID NO:262(encoded by SEQ ID NO:261) |
| Q | SEQ ID NO:318(encoded by SEQ ID NO:317) |
| R | SEQ ID NO:156(encoded by SEQ ID NO:155) |
| S | SEQ ID NO:314(encoded by SEQ ID NO:313) |
| T | SEQ ID NO:428(encoded by SEQ ID NO:427) |
| U | Control |

FIG. 26

Enzyme development path

| E2 | SEQ ID NO:106 (EG), SEQ ID NO:26 (bG) |
|---|---|
| E4.1 | SEQ ID NO:106 (EG), SEQ ID NO:26 (bG), SEQ ID NO:100 (xyl), SEQ ID NO:96 (bX) |
| E4.2 | SEQ ID NO:106 (EG), SEQ ID NO:26 (bG), CBHI, CBHII |
| E6 | SEQ ID NO:106 (EG), SEQ ID NO:26 (bG), SEQ ID NO:100 (xyl), SEQ ID NO:96 (bX), CBHI, CBHII |
| E7 | SEQ ID NO:106 (EG), SEQ ID NO:26 (bG), SEQ ID NO:100 (xyl), SEQ ID NO:96 (bX), CBHI, CBHII, SEQ ID NO:92 (AF) |
| E9 | SEQ ID NO:106 (EG), SEQ ID NO:26 (bG), SEQ ID NO:100 (xyl), SEQ ID NO:96 (bX), CBHI, CBHII, SEQ ID NO:92 (AF), SEQ ID NO:440 (FAE), SEQ ID NO:442 (aG) |

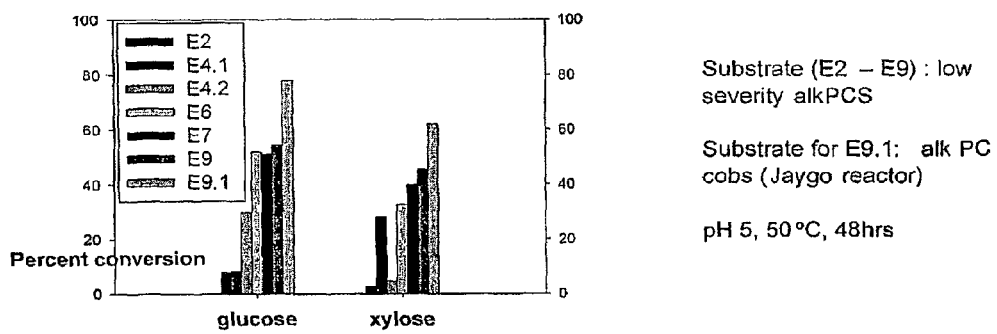

Substrate (E2 – E9) : low severity alkPCS

Substrate for E9.1: alk PC cobs (Jaygo reactor)

pH 5, 50 °C, 48hrs

FIG. 27

Digestion of Jaygo 1, 2, 4 and 5

|  | Glucose (mM at 48 hrs) | % theoretical glucose* | Xylose (mM at 48 hrs) | % theoretical xylose* |
|---|---|---|---|---|
| Jaygo 1 | | | | |
| - E9 | 49 | 78 | 38 | 61 |
| - Spezyme enzyme | 45 | 72 | 25 | 40 |
| Jaygo 2 | | | | |
| - E9 | 49 | 78 | 37 | 60 |
| - Spezyme enzyme | 45 | 72 | 26 | 42 |
| Jaygo 4 | | | | |
| - E9 | 46 | 74 | 33 | 53 |
| - Spezyme enzyme | 36 | 58 | 19 | 31 |
| Jaygo 5 | | | | |
| - E9 | 42 | 67 | 29 | 53 |
| - Spezyme enzyme | 44 | 70 | 21 | 39 |

*2.5% solids, 100% = 62 mM    Reactions contain metal balls

FIG. 28

| EGs | pH$_{opt}$ | Temp$_{opt}$(C) | A) Avicelase Activity/mg (mM/24 h) | CMCase Activity/mg (umol/min) | B) CMCase Units in Assay | Ratio of A to B |
|---|---|---|---|---|---|---|
| SEQ ID NO:314 | 5 | 80 | 1.02 | 1.4 | 0.3 | 3.70 |
| SEQ ID NO:294 | 5 | 60 | 0.37 | 0.6 | 0.1 | 3.33 |
| SEQ ID NO:318 | 5 | 80 | 1.51 | 2.8 | 0.6 | 2.67 |
| SEQ ID NO:308 | 5 | 60 | 1.59 | 4.2 | 0.8 | 1.89 |
| Trichoderma EG | 5 | 60 | 1.85 | 160.0 | 1.5 | 1.25 |
| SEQ ID NO:428 | 7 | 80 | 0.25 | 2.1 | 0.4 | 0.61 |
| SEQ ID NO:284 | 7 | 60 | 0.27 | 2.3 | 0.5 | 0.59 |
| SEQ ID NO:186 | 5 | 60 | 0.48 | 10.1 | 2.0 | 0.24 |
| SEQ ID NO:166 | 5 | 60 | 0.34 | 11.7 | 2.3 | 0.15 |
| SEQ ID NO:218 | 5 | 60 | 0.33 | 20.6 | 4.1 | 0.08 |
| SEQ ID NO:300 | 7 | 60 | 0.28 | 22.5 | 4.5 | 0.06 |
| SEQ ID NO:154 | 5 | 60 | 0.29 | 28.6 | 5.7 | 0.05 |
| SEQ ID NO:152 | 5 | 60 | 0.24 | 53.4 | 10.7 | 0.02 |

SEQ ID NO:106 (encoded by SEQ ID NO:105)

SEQ ID NO:150 (encoded by SEQ ID NO:149)

SEQ ID NO:92 (encoded
by SEQ ID NO:91)

FIG. 57

| E8 Cocktail | | % of powder | powder mg/mL | Enzymes mg/mL | substrate mg/mL | Glucan % | Total g cellulose | Total enzyme (mg/g cellulose) | Enzyme % | Pure enzyme (mg/g cellulose) |
|---|---|---|---|---|---|---|---|---|---|---|
| 1 | SEQ ID NO:106 (encoded by SEQ ID NO:105) | 0.63 | 2 | 1.3 | 50 | 0.4333 | 0.0217 | 58.2 | 1.00% | 0.6 |
| 2 | SEQ ID NO:264 (encoded by SEQ ID NO:263) | 0.67 | 1.5 | 1.0 | 50 | 0.4333 | 0.0217 | 46.4 | 5.60% | 2.6 |
| 3 | CBH I* | 1 | 0.25 | 0.3 | 50 | 0.4333 | 0.0217 | 11.5 | 87.00% | 10.0 |
| 4 | CBH II** | 1 | 0.1 | 0.1 | 50 | 0.4333 | 0.0217 | 4.6 | 51.00% | 2.4 |
| 5 | SEQ ID NO:100 (encoded by SEQ ID NO:99) | 0.9 | 0.1 | 0.1 | 50 | 0.4333 | 0.0217 | 4.2 | 15.50% | 0.6 |
| 6 | SEQ ID NO:96 (encoded by SEQ ID NO:95) | 0.81 | 0.5 | 0.4 | 50 | 0.4333 | 0.0217 | 18.7 | 2.70% | 0.5 |
| 7 | SEQ ID NO:92 (encoded by SEQ ID NO:91) | 0.74 | 0.025 | 0.0 | 50 | 0.4333 | 0.0217 | 0.9 | 34.00% | 0.3 |
| 8 | SEQ ID NO:440 (encoded by SEQ ID NO:439) | 1 | 0 | 0.0 | 50 | 0.4333 | 0.0217 | 0.0 | 5.00% | 0.0 |
| 9 | SEQ ID NO:442 (encoded by SEQ ID NO:441) | 1 | 0 | 0.0 | 50 | 0.4333 | 0.0217 | 0.0 | 5.00% | 0.0 |
| 10 | SEQ ID NO:102 (encoded by SEQ ID NO:101) | 1 | 0.025 | 0.0 | 50 | 0.4333 | 0.0217 | 1.2 | 18.70% | 0.2 |
| TOTAL | | | | | | | | | | 17.2 |

FIG. 58

| E8 Cocktail | | | | | | | | | |
|---|---|---|---|---|---|---|---|---|---|
| | Components | % of powder | powder mg/mL | Enzymes mg/mL | substrate mg/mL | Glucan % | Total g cellulose | Total enzyme (mg/g cellulose) | Enzyme % | Pure enzyme (mg/g cellulose) |
| 1 | SEQ ID NO:106 (encoded by SEQ ID NO:105) | 0.63 | 2 | 1.3 | 50 | 0.4333 | 0.0217 | 58.2 | 1.00% | 0.6 |
| 2 | SEQ ID NO:264 (encoded by SEQ ID NO:263) | 0.67 | 1.5 | 1.0 | 50 | 0.4333 | 0.0217 | 46.4 | 5.60% | 2.6 |
| 3 | CBH1* | 1 | 0.25 | 0.3 | 50 | 0.4333 | 0.0217 | 11.5 | 87.00% | 10.0 |
| 4 | SEQ ID NO:98 (encoded by SEQ ID NO:297) | 1 | 0.15 | 0.2 | 50 | 0.4333 | 0.0217 | 6.9 | 46.00% | 3.2 |
| 5 | SEQ ID NO:100 (encoded by SEQ ID NO:99) | 0.9 | 0.1 | 0.1 | 50 | 0.4333 | 0.0217 | 4.2 | 15.50% | 0.6 |
| 6 | SEQ ID NO:96 (encoded by SEQ ID NO:95) | 0.81 | 0.5 | 0.4 | 50 | 0.4333 | 0.0217 | 18.7 | 2.70% | 0.5 |
| 7 | SEQ ID NO:92 (encoded by SEQ ID NO:91) | 0.74 | 0.025 | 0.0 | 50 | 0.4333 | 0.0217 | 0.9 | 34.00% | 0.3 |
| 8 | SEQ ID NO:440 (encoded by SEQ ID NO:439) | 1 | 0 | | | 0.4333 | 0.000 | | 5.00% | |
| 9 | SEQ ID NO:442 (encoded by SEQ ID NO:441) | 1 | 0 | | | 0.4333 | 0.000 | | 5.00% | |
| 10 | SEQ ID NO:102 (encoded by SEQ ID NO:101) | 1 | 0.025 | 0.0 | 50 | 0.4333 | 0.0217 | 1.2 | 18.70% | 0.2 |
| | TOTAL | | | | | | | | | 18.1 |

FIG. 59

| E8 Cocktail | | | | | | | | | |
|---|---|---|---|---|---|---|---|---|---|
| | Components | % of powder | powder mg/mL | Enzymes mg/mL | substrate mg/mL | Glucan % | Total g. cellulose | Total enzyme (mg/g cellulose) | Enzyme % | Pure enzyme (mg/g cellulose) |
| 1 | SEQ ID NO:106 (encoded by SEQ ID NO:105) | 0.63 | 2 | 1.260 | 50 | 0.4333 | 0.0217 | 58.2 | 1.00% | 0.6 |
| 2 | SEQ ID NO:264 (encoded by SEQ ID NO:263) | 0.67 | 1.5 | 1.005 | 50 | 0.4333 | 0.0217 | 46.4 | 5.60% | 2.6 |
| 3 | SEQ ID NO:34 (encoded by SEQ ID NO:33) | 1 | 0.75 | 0.750 | 50 | 0.4333 | 0.0217 | 34.6 | 20.00% | 6.9 |
| 4 | SEQ ID NO:98 (encoded by SEQ ID NO:297) | 1 | 0.2 | 0.200 | 50 | 0.4333 | 0.0217 | 9.2 | 46.00% | 4.2 |
| 5 | SEQ ID NO:100 (encoded by SEQ ID NO:99) | 0.9 | 0.1 | 0.090 | 50 | 0.4333 | 0.0217 | 4.2 | 15.50% | 0.6 |
| 6 | SEQ ID NO:96 (encoded by SEQ ID NO:95) | 0.81 | 0.5 | 0.405 | 50 | 0.4333 | 0.0217 | 18.7 | 2.70% | 0.5 |
| 7 | SEQ ID NO:92 (encoded by SEQ ID NO:91) | 0.74 | 0.025 | 0.019 | 50 | 0.4333 | 0.0217 | 0.9 | 34.00% | 0.3 |
| 8 | SEQ ID NO:440 (encoded by SEQ ID NO:439) | 1 | 0 | 0.000 | 50 | 0.4333 | 0.0217 | 0.0 | 5.00% | 0.0 |
| 9 | SEQ ID NO:442 (encoded by SEQ ID NO:441) | 1 | 0 | | | 0.4333 | | | 5.00% | |
| 10 | SEQ ID NO:102 (encoded by SEQ ID NO:101) | 1 | 0.025 | 0.0 | 50 | 0.4333 | 0.0217 | 1.2 | 18.70% | 0.2 |
| | TOTAL | | | | | | | | | 16.0 |

FIG. 84

Enzyme development path

| | |
|---|---|
| E2 | SEQ ID NO:106 (EG), SEQ ID NO:26 (bG) |
| E4.1 | SEQ ID NO:106 (EG), SEQ ID NO:26 (bG), SEQ ID NO:100 (xyl), SEQ ID NO:96 (bX) |
| E4.2 | SEQ ID NO:106 (EG), SEQ ID NO:26 (bG), CBHI, CBHII |
| E6 | SEQ ID NO:106 (EG), SEQ ID NO:26 (bG), SEQ ID NO:100 (xyl), SEQ ID NO:96 (bX), CBHI, CBHII |
| E7 | SEQ ID NO:106 (EG), SEQ ID NO:26 (bG), SEQ ID NO:100 (xyl), SEQ ID NO:96 (bX), CBHI, CBHII, SEQ ID NO:92 (AF) |
| E9 | SEQ ID NO:106 (EG), SEQ ID NO:26 (bG), SEQ ID NO:100 (xyl), SEQ ID NO:96 (bX), CBHI, CBHII, SEQ ID NO:92 (AF), SEQ ID NO:440 (FAE), SEQ ID NO:442 (aG) |
| E10 | SEQ ID NO:106 (EG), SEQ ID NO:26 (bG), SEQ ID NO:100 (xyl), SEQ ID NO:96 (bX), CBHI, CBHII, SEQ ID NO:92 (AF), SEQ ID NO:440 (FAE), SEQ ID NO:442 (aG), SEQ ID NO:102 (xyl10) |

CELLULOLYTIC ENZYMES, NUCLEIC ACIDS ENCODING THEM AND METHODS FOR MAKING AND USING THEM

CROSS-REFERENCE TO RELATED APPLICATIONS

This application is a national stage application filed in compliance with 35 U.S.C. §371 of International Application No. PCT/US2006/046919, filed Dec. 8, 2006, which claims the benefit of priority to U.S. Provisional Patent Application No. 60/772,786, filed Feb. 10, 2006. The aforementioned applications are explicitly incorporated herein by reference in their entirety and for all purposes.

GOVERNMENT SUPPORT

This invention was made with United States Government support under Contract Nos. DOE 1435-04-03-CA-70224, 1435-04-04-CA-70224 and DE-FC36-03GO13146, awarded by the Department of Energy. The Government has certain rights in this invention.

SUBMISSION ON COMPACT DISC

The content of the following submission on compact discs is incorporated herein by reference in its entirety: A computer readable form (CRF) of the Sequence Listing on compact disc (file name: 564462014241, date recorded: Dec. 6, 2006, size: 1,843,200 bytes); a triplicate compact disc copy of the Sequence Listing (COPY 1) (file name: 564462014241, date recorded: Dec. 6, 2006, size: 1,843,200 bytes); a triplicate compact disc copy of the Sequence Listing (COPY 2) (file name: 564462014241, date recorded: Dec. 6, 2006, size: 1,843,200 bytes); and a triplicate compact disc copy of the Sequence Listing (COPY 3) (file name: 564462014241, date recorded: Dec. 6, 2006, size: 1,843,200 bytes).

SEQUENCE LISTING

The entire content of the following sequence listing, submitted in computer readable form (CRF) electronically via the USPTO EFS-WEB server, as authorized under MPEP §1730 II.B.2(a)(C), is incorporated herein by reference in its entirety and for all purposes. The sequence listing is identified on the electronically filed text file as follows:

| File Name | Date of Creation | Size (bytes) |
| --- | --- | --- |
| SeqListCORRECTEDD21501N.txt | Apr. 29, 2009 | 1.75 Mega Bytes |

FIELD OF THE INVENTION

This invention relates to molecular and cellular biology and biochemistry. In one aspect, the invention provides polypeptides having a cellulolytic activity, e.g., a cellulase, a endoglucanase, a cellobiohydrolase, a beta-glucosidase, a xylanase, a mannanse, a xylosidase (e.g., a β-xylosidase), an arabinofuranosidase, and/or an oligomerase activity, polynucleotides encoding these polypeptides, and methods of making and using these polynucleotides and polypeptides. In one aspect, the invention provides polypeptides having an oligomerase activity, e.g., enzymes that convert soluble oligomers to fermentable monomeric sugars in the saccharification of biomass, and polynucleotides encoding these enzymes, and making and using these polynucleotides and polypeptides. In one aspect, the invention provides thermostable and thermotolerant forms of polypeptides of the invention. The polypeptides of the invention can be used in a variety of pharmaceutical, agricultural and industrial contexts.

BACKGROUND

Cellulose is the most abundant renewable resource on earth. It is composed of a linear chain of β1-4 glucose units with the repeating unit being cellobiose, which is a glucose dimer having a structure as shown in FIG. 5. The polymer is degraded by a suite of enzymes which include endoglucanases (EG) which randomly hydrolyze the cellulose polymer, and cellobiohydrolases (CBH) which remove terminal cellobiose residues from cellulose. Cellobiose and cello-oligosaccharides are hydrolyzed to glucose by β-glucosidases (BG). All three of these enzymes are necessary for the complete breakdown of cellulose to glucose. For each of these three enzymes different structural variants exist that perform the same function. In addition, fungi and bacteria are known to produce multiple forms of the same structural variants in addition to different structural variants.

Further complicating this system is the fact that some anaerobic bacteria and fungi are known to produce these enzymes in multi-enzyme complexes which contain multiple enzymes all attached to an enzyme scaffold with molecular weights above 2 million daltons. Why is such a complex system of enzymes necessary for such a simple molecule? Some researchers believe that this complexity is due to the recalcitrant nature of the substrate. The cellulose chains form microfibrils that pack into a crystalline matrix via hydrogen bonding of adjacent chains. This structure is highly resistant to chemical or enzymatic degradation.

CBHs are thought to be the key enzyme in the degradation of this crystalline cellulose because of the nature of their enzymatic attack on cellulose. EGs unlike CBHs have an open cleft that attacks the cellulose chain at a perpendicular angle. CBHs attack the chain directly via a tunnel containing the active site. The current thought is that the cellulose chains enter the tunnel and at the same time, adjacent hydrogen bonding is disrupted. Once the cellobiohydrolases have established this "foothold" on the substrate, the EGs can then come in and more readily attack the substrate.

A major deficiency of known CBHs is their low catalytic activity. Some groups argue that the low activity stems from the fact that energy from hydrolysis is transferred to kinetic energy to disrupt hydrogen bonds and enable the enzyme to move along the substrate. CBHs are exo-acting enzymes and are found in 6 of the 90 families of glycosyl hydrolases. They include families 5, 6, 7, 9, 10 and 48. Family 5 contains many different types of glycosyl hydrolases including cellulases, mannanases and xylanases. Although most cellulases in this family are endoglucanases, there are examples of cellobiohydrolases, most notably CelO from *Clostridium thermocellum*. Family 6 contains only endoglucanases or cellobiohydrolases with more cellobiohydrolase members than endoglucanases. The enzymes have an inverting mechanism and crystallographic studies suggest that the enzyme has a distorted α/β barrel structure containing seven, not eight parallel β-strands. Family 7 enzymes are also composed of both endoglucanases and cellobiohydrolases with more cellobiohydrolases and only known members are from fungi. The enzyme has a retaining mechanism and the crystal structure suggests a β-jellyroll structure. Family 9 contains endoglucanases, cellobiohydrolases and β-glucosidases with a preponderance of endoglucanases. However, *Thermobifida fusca* produces an endo/exo-1,4-glucanase, the crystal structure of which suggests a (α/α)$_6$ barrel fold. The enzyme has characteristics of both endo and exo-glucanases CBHs. Family 10 contains only 2 members described as cellobiohydrolases with mainly the rest described as xylanases. Cellobiohydrolases and xylanases from family 10 have activity on methyl-umbelliferyl cellobioside. Family 48 contains mainly bacterial and anaerobic fungal cellobiohydrolases and endoglucanases. The structure is a (α/α)$_6$ barrel fold similar to family 9.

There is a need for less expensive and renewable sources of fuel for road vehicles. New fuel sources will be more attractive if they produce nonharmful endproducts after combustion. Ethanol offers an attractive alternative to petroleum based fuels and can be obtained through the fermentation of monomeric sugars derived from starch or lignocellulose. However, current economics do not support the widespread use of ethanol due to the high cost of generating it. One area of research aimed at decreasing costs is enhancement of the technical efficacy of the enzymes that can be used to generate fermentable sugars from biomass, e.g., lignocellulose-comprising compositions. The development of enzymes that more efficiently digest biomass, e.g., feedstocks, will translate to decreased ethanol production costs. More efficient processes will decrease the United State's reliance on foreign oil and the price fluctuations that may be related to that reliance. Using cleaner fuels for transportation like bioethanol also may decrease net $CO_2$ emissions that are believed to be partially responsible for global warming.

Due to the complexity of biomass, its conversion to monomer sugars involves the action of several different enzyme classes, as illustrated in FIGS. 6, 7, 8, 62 and 63, which includes a schematic of the enzymes involved in digestion of cellulose (FIGS. 6, 7 and 63) and hemicellulose (FIGS. 8 and 62). Biomass is composed of both carbohydrate and non-carbohydrate materials. The carbohydrates can be sub-divided into cellulose, a linear polymer of β-1,4 linked glucose moieties, and hemicellulose, a complex branched polymer consisting of a main chain of β-1,4 linked xylose with branches of arabinose, galactose, mannose and glucuronic acids. On occasion the xylose may be acetylated and arabinose may contain ferulic or cinnamic acid esters to other hemicellulose chains or to lignin. The last major constituent of biomass is lignin, a highly crosslinked phenylpropanoid structure. Cellulases convert cellulose to glucose and are composed of: (1) endoglucanases, cleaving internal β-1,4 glycosidic linkages resulting in shorter chain glucooligosaccharides, (2) cellobiohydrolases, acting on the ends of the smaller oligosaccharides resulting in cellobiose (disaccharide), and (3) β-glucosidase, converting the soluble oligosaccharides (DP2 to DP7) to glucose. Single component enzymes have been shown to only partially digest cellulose and the concerted action of all enzymes is required for complete conversion to glucose. Many more enzymes are required to digest hemicellulose to sugar monomers including xylanase, xylosidase, arabinofuranosidase, mannanase, galactosidase and glucuronidase. Non-glycosyl hydrolases such as acetyl xylan esterase and ferulic acid esterase may also be involved.

SUMMARY

The invention provides polypeptides having cellulolytic activity, e.g., cellulases activity, such as endoglucanase, cellobiohydrolase, β-glucosidase (beta-glucosidase), xylanase, xylosidase (e.g., β-xylosidase), arabinofuranosidase, and/or oligomerase activity, and nucleic acids encoding them, and methods for making and using them. In one aspect, the enzymes of the invention have an increased catalytic rate to improve the process of substrate (e.g., cellulose) hydrolysis. This increased efficiency in catalytic rate leads to an increased efficiency in producing sugars, which can be useful in industrial applications, e.g., the sugars so produced can be used by microorganisms for ethanol production. In one aspect, the invention provides highly active (e.g., having an increased catalytic rate) endoglucanases, cellobiohydrolases, β-glucosidases (beta-glucosidases), xylanases, xylosidase (e.g., β-xylosidase), arabinofuranosidases, and/or oligomerases. The invention provides industrial applications (e.g., biomass to ethanol) using enzymes of the invention having decreased enzyme costs, e.g., decreased costs in biomass to ethanol conversion processes. Thus, the invention provides efficient processes for producing bioethanol and bioethanol-comprising compositions, including fuels comprising bioethanol, from any biomass.

In one aspect, enzymes of the invention, including the enzyme "cocktails" of the invention ("cocktails" meaning mixtures of enzymes comprising at least one enzyme of this invention), are used to hydrolyze the major components of a lignocellulosic biomass, or any composition comprising cellulose and/or hemicellulose (lignocellulosic biomass also comprises lignin), e.g., seeds, grains, tubers, plant waste or byproducts of food processing or industrial processing (e.g., stalks), corn (including cobs, stover, and the like), grasses (e.g., Indian grass, such as *Sorghastrum nutans*; or, switch grass, e.g., *Panicum* species, such as *Panicum virgatum*), wood (including wood chips, processing waste), paper, pulp, recycled paper (e.g., newspaper). In one aspect, enzymes of the invention are used to hydrolyze cellulose comprising a linear chain of β-1,4-linked glucose moieties, and/or hemicellulose as a complex structure that varies from plant to plant. In one aspect, enzymes of the invention are used to hydrolyze hemicelluloses containing a backbone of β-1,4 linked xylose molecules with intermittent branches of arabinose, galactose, glucuronic acid and/or mannose. In one aspect, enzymes of the invention are used to hydrolyze hemicellulose containing non-carbohydrate constituents such as acetyl groups on xylose and ferulic acid esters on arabinose. In one aspect, enzymes of the invention are used to hydrolyze hemicelluloses covalently linked to lignin and/or coupled to other hemicellulose strands via diferulate crosslinks.

In one aspect, the compositions and methods of the invention are used in the enzymatic digestion of biomass and can comprise use of many different enzymes, including the cellulases and hemicellulases. Cellulases used to practice the invention can digest cellulose to glucose. In one aspect, compositions used to practice the invention can include mixtures of enzymes, e.g., xylanases, xylosidases (e.g., β-xylosidases), cellobiohydrolases, and/or arabinofuranosidases or other enzymes that can digest hemicellulose to monomer sugars.

In one aspect, compositions used to practice the invention include a "cellulase" that is a mixture of at least three different enzyme types, (1) endoglucanase, which cleaves internal β-1,4 linkages resulting in shorter glucooligosaccharides, (2) cellobiohydrolase, which acts in an "exo" manner processively releasing cellobiose units (β-1,4 glucose-glucose disaccharide), and (3) β-glucosidase, releasing glucose monomer from short cellooligosaccharides (e.g. cellobiose).

In one aspect, the enzymes of the invention have a glucanase, e.g., an endoglucanase, activity, e.g., catalyzing hydrolysis of internal endo-β-1,4- and/or β-1,3-glucanase linkages. In one aspect, the endoglucanase activity (e.g., endo-1,4-beta-D-glucan 4-glucano hydrolase activity) comprises hydrolysis of 1,4- and/or β-1,3-beta-D-glycosidic linkages in cellulose, cellulose derivatives (e.g., carboxy methyl cellulose and hydroxy ethyl cellulose) lichenin, beta-1,4 bonds in mixed beta-1,3 glucans, such as cereal beta-D-glucans or xyloglucans and other plant material containing cellulosic parts.

In one aspect, the enzymes of the invention have endoglucanase (e.g., endo-beta-1,4-glucanases, EC 3.2.1.4; endo-beta-1,3(1)-glucanases, EC 3.2.1.6; endo-beta-1,3-glucanases, EC 3.2.1.39) activity and can hydrolyze internal β-1,4- and/or β-1,3-glucosidic linkages in cellulose and glucan to produce smaller molecular weight glucose and glucose oligomers. The invention provides methods for producing smaller molecular weight glucose and glucose oligomers using these enzymes of the invention.

In one aspect, the enzymes of the invention are used to generate glucans, e.g., polysaccharides formed from 1,4-β- and/or 1,3-glycoside-linked D-glucopyranose. In one aspect, the endoglucanases of the invention are used in the food industry, e.g., for baking and fruit and vegetable processing, breakdown of agricultural waste, in the manufacture of animal feed, in pulp and paper production, textile manufacture and household and industrial cleaning agents. In one aspect, the enzymes, e.g., endoglucanases, of the invention are produced by a microorganism, e.g., by a fungi and/or a bacteria.

In one aspect, the enzymes, e.g., endoglucanases, of the invention are used to hydrolyze beta-glucans (β-glucans) which are major non-starch polysaccharides of cereals. The glucan content of a polysaccharide can vary significantly depending on variety and growth conditions. The physicochemical properties of this polysaccharide are such that it gives rise to viscous solutions or even gels under oxidative conditions. In addition glucans have high water-binding capacity. All of these characteristics present problems for several industries including brewing, baking, animal nutrition. In brewing applications, the presence of glucan results in wort filterability and haze formation issues. In baking applications (especially for cookies and crackers), glucans can create sticky doughs that are difficult to machine and reduce biscuit size. Thus, the enzymes, e.g., endoglucanases, of the invention are used to decrease the amount of β-glucan in a β-glucan-comprising composition, e.g., enzymes of the invention are used in processes to decrease the viscosity of solutions or gels; to decrease the water-binding capacity of a composition, e.g., a β-glucan-comprising composition; in brewing processes (e.g., to increase wort filterability and decrease haze formation), to decrease the stickiness of doughs, e.g., those for making cookies, breads, biscuits and the like.

In addition, carbohydrates (e.g., β-glucan) are implicated in rapid rehydration of baked products resulting in loss of crispiness and reduced shelf-life. Thus, the enzymes, e.g., endoglucanases, of the invention are used to retain crispiness, increase crispiness, or reduce the rate of loss of crispiness, and to increase the shelf-life of any carbohydrate-comprising food, feed or drink, e.g., a β-glucan-comprising food, feed or drink.

Enzymes, e.g., endoglucanases, of the invention are used to decrease the viscosity of gut contents (e.g., in animals, such as ruminant animals, or humans), e.g., those with cereal diets. Thus, in alternative aspects, enzymes, e.g., endoglucanases, of the invention are used to positively affect the digestibility of a food or feed and animal (e.g., human or domestic animal) growth rate, and in one aspect, are used to higher generate feed conversion efficiencies. For monogastric animal feed applications with cereal diets, beta-glucan is a contributing factor to viscosity of gut contents and thereby adversely affects the digestibility of the feed and animal growth rate. For ruminant animals, these beta-glucans represent substantial components of fiber intake and more complete digestion of glucans would facilitate higher feed conversion efficiencies. Accordingly, the invention provides animal feeds and foods comprising endoglucanases of the invention, and in one aspect, these enzymes are active in an animal digestive tract, e.g., in a stomach and/or intestine.

Enzymes, e.g., endoglucanases, of the invention are used to digest cellulose or any beta-1,4-linked glucan-comprising synthetic or natural material, including those found in any plant material. Enzymes, e.g., endoglucanases, of the invention are used as commercial enzymes to digest cellulose from any source, including all biological sources, such as plant biomasses, e.g., corn, grains, grasses (e.g., Indian grass, such as *Sorghastrum nutans*; or, switch grass, e.g., *Panicum* species, such as *Panicum virgatum*), or, woods or wood processing byproducts, e.g., in the wood processing, pulp and/or paper industry, in textile manufacture and in household and industrial cleaning agents, and/or in biomass waste processing.

In one aspect the invention provides compositions (e.g., pharmaceutical compositions, foods, feeds, drugs, dietary supplements) comprising the enzymes, polypeptides or polynucleotides of the invention. These compositions can be formulated in a variety of forms, e.g., as tablets, gels, pills, implants, liquids, sprays, powders, food, feed pellets or as any type of encapsulated form.

The invention provides isolated, synthetic or recombinant nucleic acids comprising a nucleic acid sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%; 89%, 90%, 91%, 92%, 93%, 94%, 95%, 96%, 97%, 98%, 99%, or more, or complete (100%) sequence identity to an exemplary nucleic acid of the invention, including SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:1357 SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:1, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:297, SEQ ID NO:289, SEQ ID NO:291, SEQ ID NO:293, SEQ ID NO:295, SEQ ID NO:297, SEQ ID NO:299, SEQ ID NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377, SEQ ID NO:379, SEQ ID NO:381, SEQ ID NO:383, SEQ ID NO:385, SEQ ID NO:387, SEQ ID NO:389, SEQ D NO:391, SEQ ID NO:393, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO:415, SEQ ID NO:417, SEQ ID NO:419, SEQ BD NO:421, SEQ ID NO:423, SEQ ID NO:425, SEQ ID NO:427, SEQ ID NO:429, SEQ ID NO:431, SEQ ID NO:433, SEQ ID NO: 435, SEQ ID NO:437, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:475, SEQ ID NO:477, SEQ ID NO:479, SEQ ID NO:481, SEQ ID NO:483, SEQ ID NO:485, SEQ ID NO:487, SEQ ID NO:489, SEQ ID NO:491, SEQ ID NO:493, SEQ ID NO:495, SEQ ID NO:497, SEQ ID NO:499, SEQ ID NO:501, SEQ ID NO:503, SEQ ID NO:505, SEQ ID NO:507, SEQ ID NO:509, SEQ ID NO:511, SEQ ID NO:513, SEQ ID NO:515, SEQ ID NO:517, SEQ ID NO:519, SEQ ID NO:521 and/or SEQ ID NO:523; see also Tables 1, 2, and 3, Examples 1 and 4, below, and Sequence Listing, over a region of at least about 10, 15, 20, 25, 30, 35, 40, 45, 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1800, 1850, 1900, 1950, 2000, 2050, 2100, 2200, 2250, 2300, 2350, 2400, 2450, 2500, or more residues; and in alternative aspects, these nucleic acids encode at least one polypeptide having a cellulolytic activity, e.g., a cellulase activity, e.g., endoglucanase, cellobiohydrolase, β-glucosidase (beta-glucosidase), xylanase, xylosidase (e.g., β-xylosidase), arabinofuranosidase, and/or oligomerase activity. An oligomerase can, e.g., can hydrolyze (degrade) soluble cellooligosaccharides and arabinoxylan oligomers into monomer xylose, arabinose and glucose, or encode a polypeptide capable of generating an antibody that can specifically bind to a polypeptide of the invention, or, these nucleic acids can be used as probes for identifying or isolating cellulase-encoding nucleic acids, or to inhibit the expression of cellulase-expressing nucleic acids (all these aspects referred to as the "nucleic acids of the invention"). In one aspect, the sequence identities are determined by analysis with a sequence comparison algorithm or by a visual inspection.

Nucleic acids of the invention also include isolated, synthetic or recombinant nucleic acids encoding an exemplary enzyme of the invention, including a polypeptide having the sequence of (a sequence as set forth in) SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:143, SEQ BD NO:146, SEQ ID NO:148, SEQ ID NO:150, SEQ ID NO:152, SEQ ID NO:154, SEQ ID NO: 156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:209, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO: 436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO: 490, SEQ ID NO:492, SEQ ID NO:494, SEQ ID NO:496, SEQ ID NO:498, SEQ ID NO:500, SEQ ID NO:502, SEQ ID NO:504, SEQ ID NO:506, SEQ ID NO:508, SEQ ID NO:510, SEQ ID NO:512, SEQ ID NO:514, SEQ ID NO:516, SEQ ID NO:518, SEQ ID NO:520, SEQ ID NO:522 and/or SEQ ID NO:524 see also Tables 1, 2, and 3, Examples 1 and 4, below, and the Sequence Listing, and subsequences thereof and variants thereof. In one aspect, the polypeptide has a cellulolytic activity, e.g., a cellulase activity, e.g., endoglucanase, cellobiohydrolase, β-glucosidase (beta-glucosidase), xylanase, xylosidase (e.g., β-xylosidase), arabinofuranosidase, and/or oligomerase. An oligomerase can, e.g., can hydrolyze (degrade) soluble cellooligsaccharides and arabinoxylan oligomers into monomer xylose, arabinose and glucose.

In one aspect, the invention provides nucleic acids encoding cellulolytic enzymes, e.g., endoglucanase, cellobiohydrolase, β-glucosidase (beta-glucosidase), xylanase, xylosidase (e.g., β-xylosidase), arabinofuranosidase, and/or oligomerase-encoding nucleic acids having a common novelty in that they are derived from mixed cultures. The invention provides cellulose or oligosaccharide hydrolyzing (degrading) enzyme-encoding nucleic acids isolated from mixed cultures comprising a polynucleotide of the invention, e.g., a sequence having at least about 10%, 15%, 20%, 25%, 30%, 35%, 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention, e.g., SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ TD NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ BD NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ BD NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287, SEQ ID NO:289, SEQ ID NO:291, SEQ ID NO:293, SEQ ID NO:295, SEQ ID NO:297, SEQ ID NO:299, SEQ ID NO:301, SEQ ID NO:303, SEQ ID NO:305, SEQ ID NO:307, SEQ BD NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377, SEQ ID NO:379, SEQ ID NO:381, SEQ ID NO:383, SEQ ID NO:385, SEQ ID NO:387, SEQ ID NO:389, SEQ ID NO:391, SEQ ID NO:393, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO:415, SEQ ID NO:417, SEQ ID NO:419, SEQ ID NO:421, SEQ ID NO:423, SEQ ID NO:425, SEQ ID NO:427, SEQ ID NO:429, SEQ ID NO:431, SEQ ID NO:433, SEQ ID NO: 435, SEQ ID NO:437, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:475, SEQ ID NO:477, SEQ ID NO:479, SEQ ID NO:481, SEQ ID NO:483, SEQ ID NO:485, SEQ ID NO:487, SEQ ID NO:489, SEQ ID NO:491, SEQ ID NO:493, SEQ ID NO:495, SEQ ID NO:497, SEQ ID NO:499, SEQ ID NO:501, SEQ ID NO:503, SEQ ID NO:505, SEQ ID NO:507, SEQ ID NO:509, SEQ ID NO:511, SEQ ID NO:513, SEQ ID NO:515, SEQ ID NO:517, SEQ ID NO:519, SEQ ID NO:521 and/or SEQ ID NO:523 and see Tables 1, 2, and 3, Examples 1 and 4, below, and Sequence Listing, over a region of at least about 50, 75, 100, 150, 200, 250, 300, 350, 400, 450, 500, 550, 600, 650, 700, 750, 800, 850, 900, 950, 1000, 1050, 1100, 1150, or more.

In one aspect, the invention provides nucleic acids encoding cellulolytic enzymes, e.g., endoglucanase enzyme, cellobiohydrolase enzyme, β-glucosidase enzyme (beta-glucosidase enzyme), xylanase enzyme, xylosidase (e.g., β-xylosidase) enzyme, arabinofuranosidase enzyme, and/or oligomerase enzyme-encoding nucleic acids, including exemplary polynucleotide sequences of the invention, see also Tables 1, 2, and 3, Examples 1 and 4, below, and Sequence Listing, and the polypeptides encoded by them, including enzymes of the invention, e.g., exemplary polypeptides of the invention, e.g., SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO: 94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:143, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:209, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO: 436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO: 490, SEQ ID NO:492, SEQ ID NO:494, SEQ ID NO:496, SEQ ID NO:498, SEQ ID NO:500, SEQ ID NO:502, SEQ ID NO:504, SEQ ID NO:506, SEQ ID NO:508, SEQ ID NO:510, SEQ ID NO:512, SEQ ID NO:514, SEQ ID NO:516, SEQ ID NO:518, SEQ ID NO:520, SEQ ID NO:522 and/or SEQ ID NO:524 see also Table 1 and Sequence Listing, having a common novelty in that they are derived from a common source, e.g., an environmental source. Table 3, below, indicates the source of each enzyme of the invention. In one aspect, the invention also provides cellulase enzyme-, e.g., endoglucanase enzyme, cellobiohydrolases enzyme, β-glucosidase enzyme (beta-glucosidase enzyme), xylanase enzyme, xylosidase (e.g., β-xylosidase), arabinofuranosidase enzyme, and/or oligomerase enzyme-encoding nucleic acids with a common novelty in that they are derived from environmental sources, e.g., mixed environmental sources.

In one aspect, the sequence comparison algorithm is a BLAST version 2.2.2 algorithm where a filtering setting is set to blastall -p blastp -d "nr pataa" -F F, and all other options are set to default.

Another aspect of the invention is an isolated, synthetic or recombinant nucleic acid including at least 10, 15, 20, 25, 30, 35, 40, 45, 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1800, 1850, 1900, 1950, 2000, 2050, 2100, 2200, 2250, 2300, 2350, 2400, 2450, 2500, or more consecutive bases of a nucleic acid sequence of the invention, sequences substantially identical thereto, and the sequences complementary thereto.

In one aspect, the isolated, synthetic or recombinant nucleic acids of the invention encode a polypeptide having a cellulolytic activity, e.g., a cellulose activity, e.g., endoglucanase, cellobiohydrolase, β-glucosidase (beta-glucosidase), xylanase, xylosidase (e.g., β-xylosidase), arabinofuranosidase, and/or oligomerase activity, or an oligomerase activity, e.g., can hydrolyze (degrade) soluble cellooligsaccharides and arabinoxylan oligomers into monomer xylose, arabinose and glucose, which is thermostable. The polypeptide can retain a cellulase or an oligomerase activity under conditions comprising a temperature range of between about 37° C. to about 95° C.; between about 55° C. to about 85° C., between about 70° C. to about 95° C., or, between about 90° C. to about 95° C. The polypeptide can retain a cellulase or an oligomerase activity in temperatures in the range between about 1° C. to about 5° C., between about 5° C. to about 15° C., between about 15° C. to about 25° C., between about 25° C. to about 37° C., between about 37° C. to about 95° C., 96° C., 97° C., 98° C. or 99° C., between about 55° C. to about 85° C., between about 70° C. to about 75° C., or between about 90° C. to about 99° C., or 95° C., 96° C., 97° C., 98° C. or 99° C., or more.

In another aspect, the isolated, synthetic or recombinant nucleic acid encodes a polypeptide having a cellulolytic activity, e.g., a cellulase activity, e.g., endoglucanase, cellobiohydrolase, β-glucosidase (beta-glucosidase), xylanase, xylosidase (e.g., β-xylosidase), arabinofuranosidase, and/or oligomerase activity, e.g., can hydrolyze (degrade) soluble cellooligsaccharides and arabinoxylan oligomers into monomer xylose, arabinose and glucose, which is thermotolerant. The polypeptide can retain a cellulase or an oligomerase activity after exposure to a temperature in the range from greater than 37° C. to about 95° C. or anywhere in the range from greater than 55° C. to about 85° C. The polypeptide can retain a cellulase or an oligomerase activity after exposure to a temperature in the range between about 1° C. to about 5° C., between about 5° C. to about 15° C., between about 15° C. to about 25° C., between about 25° C. to about 37° C., between about 37° C. to about 95° C., 96° C., 97° C., 98° C. or 99° C., between about 55° C. to about 85° C., between about 70° C. to about 75° C., or between about 90° C. to about 95° C., or more. In one aspect, the polypeptide retains a cellulase or an oligomerase activity after exposure to a temperature in the range from greater than 90° C. to about 99° C., or 95° C., 96° C., 97° C., 98° C. or 99° C., at about pH 4.5, or more.

The invention provides isolated, synthetic or recombinant nucleic acids comprising a sequence that hybridizes under stringent conditions to a nucleic acid of the invention, including an exemplary sequence of the invention, e.g., the sequence of SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ NO:133, SEQ ID NO:135, SEQ ID NO:137, SEQ ID NO:139, SEQ NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287, SEQ ID NO:289, SEQ ID NO:291, SEQ ID NO:293, SEQ ID NO:295, SEQ ID NO:297, SEQ BD NO:299, SEQ ID NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377, SEQ ID NO:379, SEQ ID NO:381, SEQ ID NO:383, SEQ ID NO:385, SEQ ID NO:387, SEQ ID NO:389, SEQ ID NO:391, SEQ ID NO:393, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO:415, SEQ ID NO:417, SEQ ID NO:419, SEQ ID NO:421, SEQ ID NO:423, SEQ ID NO:425, SEQ ID NO:427, SEQ ID NO:429, SEQ ID NO:431, SEQ ID NO:433, SEQ ID NO: 435, SEQ ID NO:437, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:475, SEQ ID NO:477, SEQ ID NO:479, SEQ ID NO:481, SEQ ID NO:483, SEQ ID NO:485, SEQ ID NO:487, SEQ ID NO:489, SEQ ID NO:491, SEQ ID NO:493, SEQ ID NO:495, SEQ ID NO:497, SEQ ID NO:499, SEQ ID NO:501, SEQ ID NO:503, SEQ ID NO:505, SEQ ID NO:507, SEQ ID NO:509, SEQ ID NO:511, SEQ ID NO:513, SEQ ID NO:515, SEQ ID NO:517, SEQ ID NO:519, SEQ ID NO:521 and/or SEQ ID NO: 523 (see also Tables 1, 2, and 3, Examples 1 and 4, below), or fragments or subsequences thereof. In one aspect, the nucleic acid encodes a polypeptide having a cellulase, e.g., endoglucanase, cellobiohydrolase, β-glucosidase (beta-glucosidase), xylanase, xylosidase (e.g., β-xylosidase), arabinofuranosidase, and/or oligomerase activity, or can hydrolyze (degrade) soluble cellooligsaccharides and arabinoxylan oligomers into monomer xylose, arabinose and glucose. The nucleic acid can be at least about 10, 15, 20, 25, 30, 35, 40, 45, 50, 75, 100, 150, 200, 250, 300, 350, 400, 450, 500, 550, 600, 650, 700, 750, 800, 850, 900, 950, 1000, 1050, 1100, 1150, 1200 or more residues in length or the full length of the gene or transcript. In one aspect, the stringent conditions comprise a wash step comprising a wash in 0.2×SSC at a temperature of about 65° C. for about 15 minutes.

The invention provides a nucleic acid probe for identifying or isolating a nucleic acid encoding a polypeptide having a cellulase, e.g., endoglucanase, cellobiohydrolase, β-glucosidase (beta-glucosidase), xylanase, xylosidase (e.g., β-xylosidase), arabinofuranosidase, and/or oligomerase activity, or can hydrolyze (degrade) soluble cellooligsaccharides and arabinoxylan oligomers into monomer xylose, arabinose and glucose, wherein the probe comprises at least about 10, 15, 20, 25, 30, 35, 40, 45, 50, 55, 60, 65, 70, 75, 80, 85, 90, 95, 100, 150, 200, 250, 300, 350, 400, 450, 500, 550, 600, 650, 700, 750, 800, 850, 900, 950, 1000 or more, consecutive bases of a sequence comprising a sequence of the invention, or fragments or subsequences thereof, wherein the probe identifies the nucleic acid by binding or hybridization. The probe can comprise an oligonucleotide comprising at least about 10 to 50, about 20 to 60, about 30 to 70, about 40 to 80, or about 60 to 100 consecutive bases of a sequence comprising a sequence of the invention, or fragments or subsequences thereof.

The invention provides a nucleic acid probe for identifying or isolating a nucleic acid encoding a polypeptide having a cellulase, e.g., endoglucanase, cellobiohydrolase, β-glucosidase (beta-glucosidase), xylanase, xylosidase (e.g., β-xylosidase), arabinofuranosidase, and/or oligomerase activity, or can hydrolyze (degrade) soluble cellooligsaccharides and arabinoxylan oligomers into monomer xylose, arabinose and glucose, wherein the probe comprises a nucleic acid comprising a sequence at least about 10, 15, 20, 30, 40, 50, 60, 70, 80, 90, 100, 150, 200, 250, 300, 350, 400, 450, 500, 550, 600, 650, 700, 750, 800, 850, 900, 950, 1000 or more residues of a nucleic acid of the invention, e.g., a polynucleotide having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention. In one aspect, the sequence identities are determined by analysis with a sequence comparison algorithm or by visual inspection. In alternative aspects, the probe can comprise an oligonucleotide comprising at least about 10 to 50, about 20 to 60, about 30 to 70, about 40 to 80, or about 60 to 100 consecutive bases of a nucleic acid sequence of the invention, or a subsequence thereof.

The invention provides an amplification primer pair for amplifying (e.g., by PCR) a nucleic acid encoding a polypeptide having a cellulase, e.g., endoglucanase, cellobiohydrolase, β-glucosidase (beta-glucosidase), xylanase, xylosidase (e.g., β-xylosidase), arabinofuranosidase, and/or oligomerase activity, or can hydrolyze (degrade) soluble cellooligsaccharides and arabinoxylan oligomers into monomer xylose, arabinose and glucose, wherein the primer pair is capable of amplifying a nucleic acid comprising a sequence of the invention, or fragments or subsequences thereof. One or each member of the amplification primer sequence pair can comprise an oligonucleotide comprising at least about 10 to 50, or more, consecutive bases of the sequence, or about 10, 11, 12, 13, 14, 15, 16, 17, 18, 19, 20, 21, 22, 23, 24, 25, 26, 27, 28, 29, 30, 31, 32, 33, 34, 35, 36 or more consecutive bases of the sequence. The invention provides amplification primer pairs, wherein the primer pair comprises a first member having a sequence as set forth by about the first (the 5') 12, 13, 14, 15, 16, 17, 18, 19, 20, 21, 22, 23, 24, 25, 26, 27, 28, 29, 30, 31, 32, 33, 34, 35, 36 or more residues of a nucleic acid of the invention, and a second member having a sequence as set forth by about the first (the 5') 12, 13, 14, 15, 16, 17, 18, 19, 20, 21, 22, 23, 24, 25, 26, 27, 28, 29, 30, 31, 32, 33, 34, 35, 36 or more residues of the complementary strand of the first member.

The invention provides cellulase-encoding, e.g., endoglucanase, cellobiohydrolase, β-glucosidase (beta-glucosidase), xylanase, xylosidase (e.g., β-xylosidase), arabinofuranosidase, and/or oligomerase-encoding nucleic acids generated by amplification, e.g., polymerase chain reaction (PCR), using an amplification primer pair of the invention. The invention provides cellulase-encoding, e.g., endoglucanase, cellobiohydrolase, β-glucosidase (beta-glucosidase), xylanase, xylosidase (e.g., β-xylosidase), arabinofuranosidase, and/or oligomerase-encoding nucleic acids generated by amplification, e.g., polymerase chain reaction (PCR), using an amplification primer pair of the invention. The invention provides methods of making a cellulase, e.g., endoglucanase, cellobiohydrolase, β-glucosidase (beta-glucosidase), xylanase, xylosidase (e.g., β-xylosidase), arabinofuranosidase, and/or oligomerase, by amplification, e.g., polymerase chain reaction (PCR), using an amplification primer pair of the invention. In one aspect, the amplification primer pair amplifies a nucleic acid from a library, e.g., a gene library, such as an environmental library.

The invention provides methods of amplifying a nucleic acid encoding a polypeptide having a cellulase activity, e.g., endoglucanase, cellobiohydrolase, β-glucosidase (beta-glucosidase), xylanase, xylosidase (e.g., β-xylosidase), arabinofuranosidase, and/or oligomerase, or can hydrolyze (degrade) soluble cellooligsaccharides and arabinoxylan oligomers into monomer xylose, arabinose and glucose, comprising amplification of a template nucleic acid with an amplification primer sequence pair capable of amplifying a nucleic acid sequence of the invention, or fragments or subsequences thereof.

The invention provides expression cassettes comprising a nucleic acid of the invention or a subsequence thereof. In one aspect, the expression cassette can comprise the nucleic acid that is operably linked to a promoter. The promoter can be a viral, bacterial, mammalian or plant promoter. In one aspect, the plant promoter can be a potato, rice, corn, wheat, tobacco or barley promoter. The promoter can be a constitutive promoter. The constitutive promoter can comprise CaMV35S. In another aspect, the promoter can be an inducible promoter. In one aspect, the promoter can be a tissue-specific promoter or an environmentally regulated or a developmentally regulated promoter. Thus, the promoter can be, e.g., a seed-specific, a leaf-specific, a root-specific, a stem-specific or an abscission-induced promoter. In one aspect, the expression cassette can further comprise a plant or plant virus expression vector.

The invention provides cloning vehicles comprising an expression cassette (e.g., a vector) of the invention or a nucleic acid of the invention. The cloning vehicle can be a viral vector, a plasmid, a phage, a phagemid, a cosmid, a fosmid, a bacteriophage or an artificial chromosome. The viral vector can comprise an adenovirus vector, a retroviral vector or an adeno-associated viral vector. The cloning vehicle can comprise a bacterial artificial chromosome (BAC), a plasmid, a bacteriophage P1-derived vector (PAC), a yeast artificial chromosome (YAC), or a mammalian artificial chromosome (MAC).

The invention provides transformed cell comprising a nucleic acid of the invention or an expression cassette (e.g., a vector) of the invention, or a cloning vehicle of the invention. In one aspect, the transformed cell can be a bacterial cell, a mammalian cell, a fungal cell, a yeast cell, an insect cell or a plant cell. In one aspect, the plant cell can be soybeans, rapeseed, oilseed, tomato, cane sugar, a cereal, a potato, wheat, rice, corn, tobacco or barley cell.

The invention provides transgenic non-human animals comprising a nucleic acid of the invention or an expression cassette (e.g., a vector) of the invention. In one aspect, the animal is a mouse, a rat, a pig, a goat or a sheep.

The invention provides transgenic plants comprising a nucleic acid of the invention or an expression cassette (e.g., a vector) of the invention. The transgenic plant can be a cereal plant, a corn plant, a potato plant, a tomato plant, a wheat plant, an oilseed plant, a rapeseed plant, a soybean plant, a rice plant, a barley plant or a tobacco plant.

The invention provides transgenic seeds comprising a nucleic acid of the invention or an expression cassette (e.g., a vector) of the invention. The transgenic seed can be a cereal plant, a corn seed, a wheat kernel, an oilseed, a rapeseed, a soybean seed, a palm kernel, a sunflower seed, a sesame seed, a peanut or a tobacco plant seed.

The invention provides an antisense oligonucleotide comprising a nucleic acid sequence complementary to or capable of hybridizing under stringent conditions to a nucleic acid of the invention. The invention provides methods of inhibiting the translation of a cellulase, e.g., endoglucanase, cellobiohydrolase, mannanase, β-glucosidase (beta-glucosidase), xylanase, xylosidase (e.g., β-xylosidase), arabinofuranosidase, and/or oligomerase enzyme message in a cell comprising administering to the cell or expressing in the cell an antisense oligonucleotide comprising a nucleic acid sequence complementary to or capable of hybridizing under stringent conditions to a nucleic acid of the invention. In one aspect, the antisense oligonucleotide is between about 10 to 50, about 20 to 60, about 30 to 70, about 40 to 80, or about 60 to 100 bases in length, e.g., 10, 15, 20, 25, 30, 35, 40, 45, 50, 55, 60, 65, 70, 75, 80, 85, 90, 95, 100 or more bases in length. The invention provides methods of inhibiting the translation of a cellulase enzyme, e.g., endoglucanase, cellobiohydrolase, β-glucosidase (beta-glucosidase), xylanase, xylosidase (e.g., β-xylosidase), arabinofuranosidase, and/or oligomerase enzyme message in a cell comprising administering to the cell or expressing in the cell an antisense oligonucleotide comprising a nucleic acid sequence complementary to or capable of hybridizing under stringent conditions to a nucleic acid of the invention.

The invention provides double-stranded inhibitory RNA (RNAi, or RNA interference) molecules (including small interfering RNA, or siRNAs, for inhibiting transcription, and microRNAs, or miRNAs, for inhibiting translation) comprising a subsequence of a sequence of the invention. In one aspect, the siRNA is between about 21 to 24 residues, or, about at least 15, 16, 17, 18, 19, 20, 21, 22, 23, 24, 25, 26, 27, 28, 29, 30, 31, 32, 33, 34, 35, 40, 45, 50, 55, 60, 65, 70, 75, 80, 85, 90, 95, 100 or more duplex nucleotides in length. The invention provides methods of inhibiting the expression of a cellulase enzyme, e.g., endoglucanase, cellobiohydrolase, β-glucosidase (beta-glucosidase), xylanase, xylosidase (e.g., β-xylosidase), arabinofuranosidase, and/or oligomerase activity, e.g., can hydrolyze (degrade) soluble cellooligosaccharides and arabinoxylan oligomers into monomer xylose, arabinose and glucose, in a cell comprising administering to the cell or expressing in the cell a double-stranded inhibitory RNA (siRNA or miRNA), wherein the RNA comprises a subsequence of a sequence of the invention.

The invention provides isolated, synthetic or recombinant polypeptides comprising an amino acid sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary polypeptide or peptide of the invention over a region of at least about 10, 15, 20, 25, 30, 35, 40, 45, 50, 55, 60, 65, 70, 75, 80, 85, 90, 95, 100, 125, 150, 175, 200, 225, 250, 275, 300, 325, 350 or more residues, or over the full length of the polypeptide. In one aspect, the sequence identities are determined by analysis with a sequence comparison algorithm or by a visual inspection. Exemplary polypeptide or peptide sequences of the invention include SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:10, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ED NO:134, SEQ ID NO:136, SEQ ID NO:138, SEQ ID NO:140, SEQ ID NO:142, SEQ ID NO:143, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:209, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ D NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO: 436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO: 490, SEQ ID NO:492, SEQ ID NO:494, SEQ ID NO:496, SEQ ID NO:498, SEQ ID NO:500, SEQ ID NO:502, SEQ ID NO:504, SEQ ID NO:506, SEQ ID NO:508, SEQ ID NO:510, SEQ ID NO:512, SEQ ID NO:514, SEQ ID NO:516, SEQ ID NO:518, SEQ ID NO:520, SEQ ID NO:522 and/or SEQ ID NO:524 (see also Tables 1, 2, and 3, Examples 1 and 4, below, and Sequence Listing), and subsequences thereof and variants thereof. Exemplary polypeptides also include fragments of at least about 10, 15, 20, 25, 30, 35, 40, 45, 50, 75, 80, 85, 90, 95, 100, 150, 200, 250, 300, 350, 400, 450, 500, 550, 600 or more residues in length, or over the full length of an enzyme. Polypeptide or peptide sequences of the invention include sequence encoded by a nucleic acid of the invention. Polypeptide or peptide sequences of the invention include polypeptides or peptides specifically bound by an antibody of the invention (e.g., epitopes), or polypeptides or peptides that can generate an antibody of the invention (e.g., an immunogen).

In one aspect, a polypeptide of the invention has at least one cellulase enzyme, e.g., endoglucanase, cellobiohydrolase, β-glucosidase (beta-glucosidase), xylanase, xylosidase (e.g., β-xylosidase), arabinofuranosidase, and/or oligomerase enzyme activity. In alternative aspects, a polynucleotide of the invention encodes a polypeptide that has at least one cellulase enzyme, e.g., endoglucanase, cellobiohydrolase, β-glucosidase (beta-glucosidase), xylanase, β-xylosidase, arabinofuranosidase, and/or oligomerase enzyme.

In one aspect, the cellulase, e.g., endoglucanase, cellobiohydrolase, mannanase, β-glucosidase (beta-glucosidase), xylanase, xylosidase (e.g., β-xylosidase), arabinofuranosidase, and/or oligomerase activity is thermostable. The polypeptide can retain a cellulase, e.g., endoglucanase, cel- lobiohydrolase, β-glucosidase (beta-glucosidase), xylanase, mannanase, β-xylosidase, arabinofuranosidase, and/or oligomerase enzyme activity under conditions comprising a temperature range of between about 1° C. to about 5° C., between about 5° C. to about 15° C., between about 15° C. to about 25° C., between about 25° C. to about 37° C., between about 37° C. to about 95° C., between about 55° C. to about 85° C., between about 70° C. to about 75° C., or between about 90° C. to about 95° C., or more. In another aspect, the cellulase, e.g., endoglucanase, cellobiohydrolase, β-glucosidase (beta-glucosidase), mannanase, xylanase, β-xylosidase, arabinofuranosidase, and/or oligomerase enzyme activity can be thermotolerant. The polypeptide can retain a cellulase, e.g., endoglucanase, cellobiohydrolase, β-glucosidase (beta-glucosidase), xylanase, mannanase, β-xylosidase, arabinofuranosidase, and/or oligomerase activity after exposure to a temperature in the range from greater than 37° C. to about 95° C., or in the range from greater than 55° C. to about 85° C. In one aspect, the polypeptide can retain a cellulase, e.g., endoglucanase, cellobiohydrolase, β-glucosidase (beta-glucosidase), xylanase, mannanase, β-xylosidase, arabinofuranosidase, and/or oligomerase activity, after exposure to a temperature in the range from greater than 90° C. to about 95° C. at pH 4.5.

Another aspect of the invention provides an isolated, synthetic or recombinant polypeptide or peptide comprising at least 10, 15, 20, 25, 30, 35, 40, 45, 50, 55, 60, 65, 70, 75, 80, 85, 90, 95, 100, 125, 150 or more consecutive bases of a polypeptide or peptide sequence of the invention, sequences substantially identical thereto, and the sequences complementary thereto. The peptide can be, e.g., an immunogenic fragment, a motif (e.g., a binding site), a signal sequence, a prepro sequence or an active site.

The invention provides isolated, synthetic or recombinant nucleic acids comprising a sequence encoding a polypeptide having a cellulase, e.g., endoglucanase, cellobiohydrolase, β-glucosidase (beta-glucosidase), mannanase, xylanase, xylosidase (e.g., β-xylosidase), arabinofuranosidase, and/or oligomerase enzyme activity and a signal sequence, wherein the nucleic acid comprises a sequence of the invention. The signal sequence can be derived from another cellulase, e.g., endoglucanase, cellobiohydrolase, β-glucosidase (beta-glucosidase), mannanase, xylanase, β-xylosidase, arabinofuranosidase, and/or oligomerase enzyme or a non-cellulase, e.g., non-endoglucanase, non-cellobiohydrolase, non-β-glucosidase (non-beta-glucosidase), non-xylanase, non-mannanase, non-β-xylosidase, non-arabinofuranosidase, and/or non-oligomerase (a heterologous) enzyme. The invention provides isolated, synthetic or recombinant nucleic acids comprising a sequence encoding a polypeptide having a cellulase, e.g., endoglucanase, cellobiohydrolase, β-glucosidase (beta-glucosidase), xylanase, β-xylosidase, mannanase, arabinofuranosidase, and/or oligomerase enzyme activity, wherein the sequence does not contain a signal sequence and the nucleic acid comprises a sequence of the invention. In one aspect, the invention provides an isolated, synthetic or recombinant polypeptide comprising a polypeptide of the invention lacking all or part of a signal sequence. In one aspect, the isolated, synthetic or recombinant polypeptide can comprise the polypeptide of the invention comprising a heterologous signal sequence, such as a heterologous cellulase, e.g., endoglucanase, cellobiohydrolase, β-glucosidase (beta-glucosidase), xylanase, mannanse, β-xylosidase, arabinofuranosidase, and/ or oligomerase enzyme signal sequence or non-cellulase, e.g., non-endoglucanase, non-cellobiohydrolase, non-β-glucosidase (non-beta-glucosidase), non-xylanase, non-mannanse, non-β-xylosidase, non-arabinofuranosidase, and/or non-oligomerase enzyme signal sequence.

In one aspect, the invention provides chimeric proteins comprising a first domain comprising a signal sequence of the invention and at least a second domain. The protein can be a fusion protein. The second domain can comprise an enzyme. The enzyme can be a non-enzyme.

The invention provides chimeric polypeptides comprising at least a first domain comprising signal peptide (SP), a prepro sequence and/or a catalytic domain (CD) of the invention and at least a second domain comprising a heterologous polypeptide or peptide, wherein the heterologous polypeptide or peptide is not naturally associated with the signal peptide (SP), prepro sequence and/or catalytic domain (CD). In one aspect, the heterologous polypeptide or peptide is not a cellulase, e.g., endoglucanase, cellobiohydrolase, β-glucosidase (beta-glucosidase), xylanase, mannanse, xylosidase (e.g., β-xylosidase), arabinofuranosidase, and/or oligomerase enzyme. The heterologous polypeptide or peptide can be amino terminal to, carboxy terminal to or on both ends of the signal peptide (SP), prepro sequence and/or catalytic domain (CD).

The invention provides isolated, synthetic or recombinant nucleic acids encoding a chimeric polypeptide, wherein the chimeric polypeptide comprises at least a first domain comprising signal peptide (SP), a prepro domain and/or a catalytic domain (CD) of the invention and at least a second domain comprising a heterologous polypeptide or peptide, wherein the heterologous polypeptide or peptide is not naturally associated with the signal peptide (SP), prepro domain and/or catalytic domain (CD).

The invention provides isolated, synthetic or recombinant signal sequences (e.g., signal peptides) consisting of or comprising the sequence of (a sequence as set forth in) residues 1 to 14, 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 28, 1 to 30, 1 to 31, 1 to 32, 1 to 33, 1 to 34, 1 to 35, 1 to 36, 1 to 37, 1 to 38, 1 to 40, 1 to 41, 1 to 42, 1 to 43, 1 to 44, 1 to 45, 1 to 46 or 1 to 47, of a polypeptide of the invention, e.g., the exemplary SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:143, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:1172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:209, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID N6:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO: 436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO:490, SEQ ID NO:492, SEQ ID NO:494, SEQ ID NO:496, SEQ ID NO:498, SEQ ID NO:500, SEQ ID NO:502, SEQ ID NO:504, SEQ ID NO:506, SEQ ID NO:508, SEQ ID NO:510, SEQ ID NO:512, SEQ ID NO:514, SEQ ID NO:516, SEQ ID NO:518, SEQ ID NO:520, SEQ ID NO:522 and/or SEQ ID NO:524 (see Tables 1, 2, and 3, Examples 1 and 4, below, and Sequence Listing). In one aspect, the invention provides signal sequences comprising the first 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70 or more amino terminal residues of a polypeptide of the invention.

In one aspect, the cellulase, e.g., endoglucanase, cellobiohydrolase, β-glucosidase (beta-glucosidase), xylanase, mannanse, β-xylosidase, arabinofuranosidase, and/or oligomerase enzyme activity comprises a specific activity at about 37° C. in the range from about 1 to about 1200 units per milligram of protein, or, about 100 to about 1000 units per milligram of protein. In another aspect, the cellulase, e.g., endoglucanase, cellobiohydrolase, β-glucosidase (beta-glucosidase), xylanase, mannanse, β-xylosidase, arabinofuranosidase, and/or oligomerase enzyme activity comprises a specific activity from about 100 to about 1000 units per milligram of protein, or, from about 500 to about 750 units per milligram of protein. Alternatively, the cellulase, e.g., endoglucanase, cellobiohydrolase, β-glucosidase (beta-glucosidase), xylanase, mannanse, β-xylosidase, arabinofuranosidase, and/or oligomerase enzyme activity comprises a specific activity at 37° C. in the range from about 1 to about 750 units per milligram of protein, or, from about 500 to about 1200 units per milligram of protein. In one aspect, the cellulase, e.g., endoglucanase, cellobiohydrolase, β-glucosidase (beta-glucosidase), xylanase, mannanse, β-xylosidase, arabinofuranosidase, and/or oligomerase enzyme activity comprises a specific activity at 37° C. in the range from about 1 to about 500 units per milligram of protein, or, from about 750 to about 1000 units per milligram of protein. In another aspect, the cellulase, e.g., endoglucanase, cellobiohydrolase, β-glucosidase (beta-glucosidase), xylanase, mannanse, β-xylosidase, arabinofuranosidase, and/or oligomerase enzyme activity comprises a specific activity at 37° C. in the range from about 1 to about 250 units per milligram of protein. Alternatively, the cellulase, e.g., endoglucanase, cellobiohydrolase, β-glucosidase (beta-glucosidase), xylanase, mannanse, β-xylosidase, arabinofuranosidase, and/or oligomerase enzyme activity comprises a specific activity at 37° C. in the range from about 1 to about 100 units per milligram of protein.

In another aspect, the thermotolerance comprises retention of at least half of the specific activity of the cellulase, e.g., endoglucanase, cellobiohydrolase, β-glucosidase (beta-glucosidase), xylanase, mannanse, β-xylosidase, arabinofuranosidase, and/or oligomerase enzyme at 37° C. after being heated to the elevated temperature. Alternatively, the thermotolerance can comprise retention of specific activity at 37° C. in the range from about 1 to about 1200 units per milligram of protein, or, from about 500 to about 1000 units per milligram of protein, after being heated to the elevated temperature. In another aspect, the thermotolerance can comprise retention of specific activity at 37° C. in the range from about 1 to about 500 units per milligram of protein after being heated to the elevated temperature.

The invention provides the isolated, synthetic or recombinant polypeptide of the invention, wherein the polypeptide comprises at least one glycosylation site. In one aspect, glycosylation can be an N-linked glycosylation. In one aspect, the polypeptide can be glycosylated after being expressed in a P. pastoris or a S. pombe.

In one aspect, the polypeptide can retain cellulase, e.g., endoglucanase, cellobiohydrolase, β-glucosidase (beta-glucosidase), xylanase, mannanse, β-xylosidase, arabinofuranosidase, and/or oligomerase enzyme activity under conditions comprising about pH 6.5, pH 6, pH 5.5, pH 5, pH 4.5 or pH 4 or more acidic. In another aspect, the polypeptide can retain cellulase, e.g., endoglucanase, cellobiohydrolase, β-glucosidase (beta-glucosidase), xylanase, mannanse, β-xylosidase, arabinofuranosidase, and/or oligomerase enzyme activity under conditions comprising about pH 7, pH 7.5 pH 8.0, pH 8.5, pH 9, pH 9.5, pH 10, pH 10.5 or pH 11 or more basic pH. In one aspect, the polypeptide can retain cellulase, e.g., endoglucanase, cellobiohydrolase, β-glucosidase (beta-glucosidase), xylanase, mannanse, β-xylosidase, arabinofuranosidase, and/or oligomerase enzyme activity after exposure to conditions comprising about pH 6.5, pH 6, pH 5.5, pH 5, pH 4.5 or pH 4 or more acidic pH. In another aspect, the polypeptide can retain cellulase, e.g., endoglucanase, cellobiohydrolase, β-glucosidase (beta-glucosidase), xylanase, mannanse, β-xylosidase, arabinofuranosidase, and/or oligomerase enzyme activity after exposure to conditions comprising about pH 7, pH 7.5 pH 8.0, pH 8.5, pH 9, pH 9.5, pH 10, pH 10.5 or pH 11 or more basic pH.

In one aspect, the cellulase, e.g., endoglucanase, cellobiohydrolase, β-glucosidase (beta-glucosidase), xylanase, mannanse, β-xylosidase, arabinofuranosidase, and/or oligomerase enzyme of the invention has activity at under alkaline conditions, e.g., the alkaline conditions of the gut, e.g., the small intestine. In one aspect, the polypeptide can retains activity after exposure to the acidic pH of the stomach.

The invention provides protein preparations comprising a polypeptide (including peptides) of the invention, wherein the protein preparation comprises a liquid, a solid or a gel. The invention provides heterodimers comprising a polypeptide of the invention and a second protein or domain. The second member of the heterodimer can be a different cellulase, e.g., endoglucanase, cellobiohydrolase, β-glucosidase (beta-glucosidase), xylanase, mannanse, β-xylosidase, arabinofuranosidase, and/or oligomerase enzyme, a different enzyme or another protein. In one aspect, the second domain can be a polypeptide and the heterodimer can be a fusion protein. In one aspect, the second domain can be an epitope or a tag. In one aspect, the invention provides homodimers comprising a polypeptide of the invention.

The invention provides immobilized polypeptides (including peptides) having cellulase, e.g., endoglucanase, cellobiohydrolase, β-glucosidase (beta-glucosidase), xylanase, mannanse, α-xylosidase, arabinofuranosidase, and/or oligomerase enzyme activity, wherein the immobilized polypeptide comprises a polypeptide of the invention, a polypeptide encoded by a nucleic acid of the invention, or a polypeptide comprising a polypeptide of the invention and a second domain. In one aspect, the polypeptide can be immobilized on a cell, a metal, a resin, a polymer, a ceramic, a glass, a microelectrode, a graphitic particle, a bead, a gel, a plate, an array or a capillary tube.

The invention also provides arrays comprising an immobilized nucleic acid of the invention, including, e.g., probes of the invention. The invention also provides arrays comprising an antibody of the invention.

The invention provides isolated, synthetic or recombinant antibodies that specifically bind to a polypeptide of the invention or to a polypeptide encoded by a nucleic acid of the invention. These antibodies of the invention can be a monoclonal or a polyclonal antibody. The invention provides hybridomas comprising an antibody of the invention, e.g., an antibody that specifically binds to a polypeptide of the invention or to a polypeptide encoded by a nucleic acid of the invention. The invention provides nucleic acids encoding these antibodies.

The invention provides method of isolating or identifying a polypeptide having cellulase, e.g., endoglucanase, cellobiohydrolase, β-glucosidase (beta-glucosidase), xylanase, mannanse, β-xylosidase, arabinofuranosidase, and/or oligomerase enzyme activity comprising the steps of: (a) providing an antibody of the invention; (b) providing a sample comprising polypeptides; and (c) contacting the sample of step (b) with the antibody of step (a) under conditions wherein the antibody can specifically bind to the polypeptide, thereby isolating or identifying a polypeptide having cellulase, e.g., endoglucanase, cellobiohydrolase, β-glucosidase (beta-glucosidase), xylanase, mannanse, β-xylosidase, arabinofuranosidase, and/or oligomerase enzyme activity.

The invention provides methods of making an anti-oligomerase, an anti-cellulase, e.g., anti-endoglucanase, anti-cellobiohydrolase, anti-β-glucosidase (anti-beta-glucosidase), anti-xylanase, anti-mannanse, anti-β-xylosidase, anti-arabinofuranosidase, and/or anti-oligomerase enzyme antibody comprising administering to a non-human animal a nucleic acid of the invention or a polypeptide of the invention or subsequences thereof in an amount sufficient to generate a humoral immune response, thereby making an anti-oligomerase or anti-cellulase, e.g., anti-endoglucanase, anti-cellobiohydrolase, anti-β-glucosidase (anti-beta-glucosidase), anti-xylanase, anti-mannanse, anti-β-xylosidase, anti-arabinofuranosidase, and/or anti-oligomerase enzyme antibody. The invention provides methods of making an anti-oligomerase or anti-cellulase, e.g., anti-endoglucanase, anti-cellobiohydrolase, anti-β-glucosidase (anti-beta-glucosidase), anti-xylanase, anti-mannanse, anti-β-xylosidase, anti-arabinofuranosidase, and/or anti-oligomerase immune response (cellular or humoral) comprising administering to a non-human animal a nucleic acid of the invention or a polypeptide of the invention or subsequences thereof in an amount sufficient to generate an immune response (cellular or humoral).

The invention provides methods of producing a recombinant polypeptide comprising the steps of: (a) providing a nucleic acid of the invention operably linked to a promoter; and (b) expressing the nucleic acid of step (a) under conditions that allow expression of the polypeptide, thereby producing a recombinant polypeptide. In one aspect, the method can further comprise transforming a host cell with the nucleic acid of step (a) followed by expressing the nucleic acid of step (a), thereby producing a recombinant polypeptide in a transformed cell.

The invention provides methods for identifying a polypeptide having cellulase, e.g., endoglucanase, cellobiohydrolase, β-glucosidase (beta-glucosidase), xylanase, mannanse, β-xylosidase, arabinofuranosidase, and/or oligomerase enzyme activity comprising the following steps: (a) providing a polypeptide of the invention; or a polypeptide encoded by a nucleic acid of the invention; (b) providing cellulase, e.g., endoglucanase, cellobiohydrolase, β-glucosidase (beta-glucosidase), xylanase, mannanse, β-xylosidase, arabinofuranosidase, and/or oligomerase enzyme substrate; and (c) contacting the polypeptide or a fragment or variant thereof of step (a) with the substrate of step (b) and detecting a decrease in the amount of substrate or an increase in the amount of a reaction product, wherein a decrease in the amount of the substrate or an increase in the amount of the reaction product detects a polypeptide having cellulase, e.g., endoglucanase, cellobiohydrolase, β-glucosidase (beta-glucosidase), xylanase, mannanse, β-xylosidase, arabinofuranosidase, and/or oligomerase enzyme activity. In one aspect, the substrate is a cellulose-comprising or a polysaccharide-comprising (e.g., soluble cellooligsaccharide- and/or arabinoxylan oligomer-comprising) compound.

The invention provides methods for identifying a cellulase, e.g., endoglucanase, cellobiohydrolase, β-glucosidase (beta-glucosidase), xylanase, mannanse, β-xylosidase, arabinofuranosidase, and/or oligomerase enzyme substrate comprising the following steps: (a) providing a polypeptide of the invention; or a polypeptide encoded by a nucleic acid of the invention; (b) providing a test substrate; and (c) contacting the polypeptide of step (a) with the test substrate of step (b) and detecting a decrease in the amount of substrate or an increase in the amount of reaction product, wherein a decrease in the amount of the substrate or an increase in the amount of a reaction product identifies the test substrate as a cellulase, e.g., endoglucanase, cellobiohydrolase, β-glucosidase (beta-glucosidase), xylanase, mannanse, β-xylosidase, arabinofuranosidase, and/or oligomerase enzyme substrate.

The invention provides methods of determining whether a test compound specifically binds to a polypeptide comprising the following steps: (a) expressing a nucleic acid or a vector comprising the nucleic acid under conditions permissive for translation of the nucleic acid to a polypeptide, wherein the nucleic acid comprises a nucleic acid of the invention, or, providing a polypeptide of the invention; (b) providing a test compound; (c) contacting the polypeptide with the test compound; and (d) determining whether the test compound of step (b) specifically binds to the polypeptide.

The invention provides methods for identifying a modulator of a cellulase, e.g., endoglucanase, cellobiohydrolase, β-glucosidase (beta-glucosidase), xylanase, mannanse, β-xylosidase, arabinofuranosidase, and/or oligomerase enzyme activity comprising the following steps: (a) providing a polypeptide of the invention or a polypeptide encoded by a nucleic acid of the invention; (b) providing a test compound; (c) contacting the polypeptide of step (a) with the test compound of step (b) and measuring an activity of the cellulase, e.g., endoglucanase, cellobiohydrolase, β-glucosidase (beta-glucosidase), xylanase, mannanse, β-xylosidase, arabinofuranosidase, and/or oligomerase enzyme, wherein a change in the cellulase, e.g., endoglucanase, cellobiohydrolase, β-glucosidase (beta-glucosidase), xylanase, mannanse, β-xylosidase, arabinofuranosidase, and/or oligomerase enzyme activity measured in the presence of the test compound compared to the activity in the absence of the test compound provides a determination that the test compound modulates the cellulase, e.g., endoglucanase, cellobiohydrolase, β-glucosidase (beta-glucosidase), xylanase, mannanse, β-xylosidase, arabinofuranosidase, and/or oligomerase enzyme activity. In one aspect, the cellulase, e.g., endoglucanase, cellobiohydrolase, β-glucosidase (beta-glucosidase), xylanase, mannanse, β-xylosidase, arabinofuranosidase, and/or oligomerase enzyme activity can be measured by providing a cellulase, e.g., endoglucanase, cellobiohydrolase, β-glucosidase (beta-glucosidase), xylanase, mannanse, β-xylosidase, arabinofuranosidase, and/or oligomerase enzyme substrate and detecting a decrease in the amount of the substrate or an increase in the amount of a reaction product, or, an increase in the amount of the substrate or a decrease in the amount of a reaction product. A decrease in the amount of the substrate or an increase in the amount of the reaction product with the test compound as compared to the amount of substrate or reaction product without the test compound identifies the test compound as an activator of cellulase, e.g., endoglucanase, cellobiohydrolase, β-glucosidase (beta-glucosidase), xylanase, mannanse, β-xylosidase, arabinofuranosidase, and/or oligomerase enzyme activity. An increase in the amount of the substrate or a decrease in the amount of the reaction product with the test compound as compared to the amount of substrate or reaction product without the test compound identifies the test compound as an inhibitor of cellulase, e.g., endoglucanase, cellobiohydrolase, β-glucosidase (beta-glucosidase), xylanase, mannanse, β-xylosidase, arabinofuranosidase, and/or oligomerase enzyme activity.

The invention provides computer systems comprising a processor and a data storage device wherein said data storage device has stored thereon a polypeptide sequence or a nucleic acid sequence of the invention (e.g., a polypeptide or peptide encoded by a nucleic acid of the invention). In one aspect, the computer system can further comprise a sequence comparison algorithm and a data storage device having at least one reference sequence stored thereon. In another aspect, the sequence comparison algorithm comprises a computer program that indicates polymorphisms. In one aspect, the computer system can further comprise an identifier that identifies one or more features in said sequence. The invention provides computer readable media having stored thereon a polypeptide sequence or a nucleic acid sequence of the invention. The invention provides methods for identifying a feature in a sequence comprising the steps of: (a) reading the sequence using a computer program which identifies one or more features in a sequence, wherein the sequence comprises a polypeptide sequence or a nucleic acid sequence of the invention; and (b) identifying one or more features in the sequence with the computer program. The invention provides methods for comparing a first sequence to a second sequence comprising the steps of: (a) reading the first sequence and the second sequence through use of a computer program which compares sequences, wherein the first sequence comprises a polypeptide sequence or a nucleic acid sequence of the invention; and (b) determining differences between the first sequence and the second sequence with the computer program. The step of determining differences between the first sequence and the second sequence can further comprise the step of identifying polymorphisms. In one aspect, the method can further comprise an identifier that identifies one or more features in a sequence. In another aspect, the method can comprise reading the first sequence using a computer program and identifying one or more features in the sequence.

The invention provides methods for isolating or recovering a nucleic acid encoding a polypeptide having cellulase, e.g., endoglucanase, cellobiohydrolase, β-glucosidase (beta-glucosidase), xylanase, mannanse, β-xylosidase, arabinofuranosidase, and/or oligomerase enzyme activity from a sample, e.g. an environmental sample, comprising the steps of: (a) providing an amplification primer sequence pair for amplifying a nucleic acid encoding a polypeptide having a cellulase, e.g., endoglucanase, cellobiohydrolase, β-glucosidase (beta-glucosidase), xylanase, mannanse, β-xylosidase, arabinofuranosidase, and/or oligomerase enzyme activity, wherein the primer pair is capable of amplifying a nucleic acid of the invention; (b) isolating a nucleic acid from the sample, e.g. environmental sample, or treating the sample, e.g. environmental sample, such that nucleic acid in the sample is accessible for hybridization to the amplification primer pair; and, (c) combining the nucleic acid of step (b) with the amplification primer pair of step (a) and amplifying nucleic acid from the sample, e.g. environmental sample, thereby isolating or recovering a nucleic acid encoding a polypeptide having a cellulase, e.g., endoglucanase, cellobiohydrolase, β-glucosidase (beta-glucosidase), xylanase, mannanse, β-xylosidase, arabinofuranosidase, and/or oligomerase enzyme activity from a sample, e.g. an environmental sample. One or each member of the amplification primer sequence pair can comprise an oligonucleotide comprising an amplification primer sequence pair of the invention, e.g., having at least about 10 to 50 consecutive bases of a sequence of the invention.

The invention provides methods for isolating or recovering a nucleic acid encoding a polypeptide having a cellulase, e.g., endoglucanase, cellobiohydrolase, β-glucosidase (beta-glucosidase), xylanase, mannanse, β-xylosidase, arabinofuranosidase, and/or oligomerase enzyme activity from a sample, e.g. an environmental sample, comprising the steps of: (a) providing a polynucleotide probe comprising a nucleic acid of the invention or a subsequence thereof; (b) isolating a nucleic acid from the sample, e.g. environmental sample, or treating the sample, e.g. environmental sample, such that nucleic acid in the sample is accessible for hybridization to a polynucleotide probe of step (a); (c) combining the isolated nucleic acid or the treated sample, e.g. environmental sample, of step (b) with the polynucleotide probe of step (a); and (d) isolating a nucleic acid that specifically hybridizes with the polynucleotide probe of step (a), thereby isolating or recovering a nucleic acid encoding a polypeptide having a cellulase, e.g., endoglucanase, cellobiohydrolase, α-glucosidase (beta-glucosidase), xylanase, mannanse, β-xylosidase, arabinofuranosidase, and/or oligomerase enzyme activity from a sample, e.g. an environmental sample. The sample, e.g. environmental sample, can comprise a water sample, a liquid sample, a soil sample, an air sample or a biological sample. In one aspect, the biological sample can be derived from a bacterial cell, a protozoan cell, an insect cell, a yeast cell, a plant cell, a fungal cell or a mammalian cell.

The invention provides methods of generating a variant of a nucleic acid encoding a polypeptide having a cellulase, e.g., endoglucanase, cellobiohydrolase, β-glucosidase (beta-glucosidase), xylanase, mannanse, β-xylosidase, arabinofuranosidase, and/or oligomerase enzyme activity comprising the steps of: (a) providing a template nucleic acid comprising a nucleic acid of the invention; and (b) modifying, deleting or adding one or more nucleotides in the template sequence, or a combination thereof, to generate a variant of the template nucleic acid. In one aspect, the method can further comprise expressing the variant nucleic acid to generate a variant cellulase, e.g., endoglucanase, cellobiohydrolase, β-glucosidase (beta-glucosidase), xylanase, mannanse, β-xylosidase, arabinofuranosidase, and/or oligomerase enzyme polypeptide. The modifications, additions or deletions can be introduced by a method comprising error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, Gene Site Saturation Mutagenesis (GSSM), synthetic ligation reassembly (SLR), Chromosomal Saturation Mutagenesis (CSM) or a combination thereof. In another aspect, the modifications, additions or deletions are introduced by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation and a combination thereof.

In one aspect, the method can be iteratively repeated until a cellulase, e.g., endoglucanase, cellobiohydrolase, β-glucosidase (beta-glucosidase), xylanase, mannanse, β-xylosidase, arabinofuranosidase, and/or oligomerase enzyme having an altered or different activity or an altered or different stability from that of a polypeptide encoded by the template nucleic acid is produced. In one aspect, the variant cellulase, e.g., endoglucanase, cellobiohydrolase, beta-glucosidase, xylanase, mannanse, β-xylosidase, arabinofuranosidase, and/or oligomerase enzyme polypeptide is thermotolerant, and retains some activity after being exposed to an elevated temperature. In another aspect, the variant cellulase, e.g., endoglucanase, cellobiohydrolase, beta-glucosidase, xylanase, mannanse, β-xylosidase, arabinofuranosidase, and/or oligomerase enzyme polypeptide has increased glycosylation as compared to the cellulase, e.g., endoglucanase, cellobiohydrolase, beta-glucosidase, xylanase, mannanse, β-xylosidase, arabinofuranosidase, and/or oligomerase enzyme encoded by a template nucleic acid. Alternatively, the variant cellulase, e.g., endoglucanase, cellobiohydrolase, beta-glucosidase, xylanase, mannanse, β-xylosidase, arabinofuranosidase, and/ or oligomerase polypeptide has a cellulase, e.g., endoglucanase, cellobiohydrolase, beta-glucosidase, xylanase, mannanse, β-xylosidase, arabinofuranosidase, and/or oligomerase enzyme activity under a high temperature, wherein the cellulase, e.g., endoglucanase, cellobiohydrolase, beta-glucosidase, xylanase, mannanse, β-xylosidase, arabinofuranosidase, and/or oligomerase enzyme encoded by the template nucleic acid is not active under the high temperature. In one aspect, the method can be iteratively repeated until a cellulase, e.g., endoglucanase, cellobiohydrolase, beta-glucosidase, xylanase, mannanse, β-xylosidase, arabinofuranosidase, and/or oligomerase enzyme coding sequence having an altered codon usage from that of the template nucleic acid is produced. In another aspect, the method can be iteratively repeated until a cellulase, e.g., endoglucanase, cellobiohydrolase, beta-glucosidase, xylanase, mannanse, β-xylosidase, arabinofuranosidase, and/or oligomerase enzyme gene having higher or lower level of message expression or stability from that of the template nucleic acid is produced.

The invention provides methods for modifying codons in a nucleic acid encoding a polypeptide having a cellulase, e.g., endoglucanase, cellobiohydrolase, beta-glucosidase, xylanase, mannanse, β-xylosidase, arabinofuranosidase, and/or oligomerase enzyme activity to increase its expression in a host cell, the method comprising the following steps: (a) providing a nucleic acid of the invention encoding a polypeptide having a cellulase, e.g., endoglucanase, cellobiohydrolase, beta-glucosidase, xylanase, mannanse, β-xylosidase, arabinofuranosidase, and/or oligomerase enzyme activity; and, (b) identifying a non-preferred or a less preferred codon in the nucleic acid of step (a) and replacing it with a preferred or neutrally used codon encoding the same amino acid as the replaced codon, wherein a preferred codon is a codon over-represented in coding sequences in genes in the host cell and a non-preferred or less preferred codon is a codon under-represented in coding sequences in genes in the host cell, thereby modifying the nucleic acid to increase its expression in a host cell.

The invention provides methods for modifying codons in a nucleic acid encoding a polypeptide having a cellulase, e.g., endoglucanase, cellobiohydrolase, beta-glucosidase, xylanase, mannanse, β-xylosidase, arabinofuranosidase, and/or oligomerase enzyme activity; the method comprising the following steps: (a) providing a nucleic acid of the invention; and, (b) identifying a codon in the nucleic acid of step (a) and replacing it with a different codon encoding the same amino acid as the replaced codon, thereby modifying codons in a nucleic acid encoding a cellulase, e.g., endoglucanase, cellobiohydrolase, beta-glucosidase, xylanase, mannanse, β-xylosidase, arabinofuranosidase, and/or oligomerase enzyme.

The invention provides methods for modifying codons in a nucleic acid encoding a polypeptide having a cellulase, e.g., endoglucanase, cellobiohydrolase, beta-glucosidase, xylanase, mannanse, β-xylosidase, arabinofuranosidase, and/or oligomerase enzyme activity to increase its expression in a host cell, the method comprising the following steps: (a) providing a nucleic acid of the invention encoding a cellulase, e.g., endoglucanase, cellobiohydrolase, beta-glucosidase, xylanase, mannanse, β-xylosidase, arabinofuranosidase, and/or oligomerase enzyme polypeptide; and, (b) identifying a non-preferred or a less preferred codon in the nucleic acid of step (a) and replacing it with a preferred or neutrally used codon encoding the same amino acid as the replaced codon, wherein a preferred codon is a codon over-represented in coding sequences in genes in the host cell and a non-preferred or less preferred codon is a codon under-represented in coding sequences in genes in the host cell, thereby modifying the nucleic acid to increase its expression in a host cell.

The invention provides methods for modifying a codon in a nucleic acid encoding a polypeptide having a cellulase, e.g., endoglucanase, cellobiohydrolase, beta-glucosidase, xylanase, mannanse, β-xylosidase, arabinofuranosidase, and/or oligomerase enzyme activity to decrease its expression in a host cell, the method comprising the following steps: (a) providing a nucleic acid of the invention; and (b) identifying at least one preferred codon in the nucleic acid of step (a) and replacing it with a non-preferred or less preferred codon encoding the same amino acid as the replaced codon, wherein a preferred codon is a codon over-represented in coding sequences in genes in a host cell and a non-preferred or less preferred codon is a codon under-represented in coding sequences in genes in the host cell, thereby modifying the nucleic acid to decrease its expression in a host cell. In one aspect, the host cell can be a bacterial cell, a fungal cell, an insect cell, a yeast cell, a plant cell or a mammalian cell.

The invention provides methods for producing a library of nucleic acids encoding a plurality of modified cellulase, e.g., endoglucanase, cellobiohydrolase, beta-glucosidase, xylanase, mannanse, β-xylosidase, arabinofuranosidase, and/or oligomerase enzyme active sites or substrate binding sites, wherein the modified active sites or substrate binding sites are derived from a first nucleic acid comprising a sequence encoding a first active site or a first substrate binding site the method comprising the following steps: (a) providing a first nucleic acid encoding a first active site or first substrate binding site, wherein the first nucleic acid sequence comprises a sequence that hybridizes under stringent conditions to a nucleic acid of the invention, and the nucleic acid encodes a cellulase, e.g., endoglucanase, cellobiohydrolase, beta-glucosidase, xylanase, mannanse, β-xylosidase, arabinofuranosidase, and/or oligomerase enzyme active site or a cellulase, e.g., endoglucanase, cellobiohydrolase, beta-glucosidase, xylanase, mannanse, β-xylosidase, arabinofuranosidase, and/or oligomerase enzyme substrate binding site; (b) providing a set of mutagenic oligonucleotides that encode naturally-occurring amino acid variants at a plurality of targeted codons in the first nucleic acid; and, (c) using the set of mutagenic oligonucleotides to generate a set of active site-encoding or substrate binding site-encoding variant nucleic acids encoding a range of amino acid variations at each amino acid codon that was mutagenized, thereby producing a library of nucleic acids encoding a plurality of modified cellulase, e.g., endoglucanase, cellobiohydrolase, beta-glucosidase, xylanase, mannanse, β-xylosidase, arabinofuranosidase, and/or oligomerase enzyme active sites or substrate binding sites. In one aspect, the method comprises mutagenizing the first nucleic acid of step (a) by a method comprising an optimized directed evolution system, Gene Site Saturation Mutagenesis (GSSM), synthetic ligation reassembly (SLR), error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, and a combination thereof. In another aspect, the method comprises mutagenizing the first nucleic acid of step (a) or variants by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation and a combination thereof.

The invention provides methods for making a small molecule comprising the following steps: (a) providing a plurality of biosynthetic enzymes capable of synthesizing or modifying a small molecule, wherein one of the enzymes comprises a cellulase, e.g., endoglucanase, cellobiohydrolase, beta-glucosidase, xylanase, mannanse, β-xylosidase, arabinofuranosidase, and/or oligomerase enzyme encoded by a nucleic acid of the invention; (b) providing a substrate for at least one of the enzymes of step (a); and (c) reacting the substrate of step (b) with the enzymes under conditions that facilitate a plurality of biocatalytic reactions to generate a small molecule by a series of biocatalytic reactions. The invention provides methods for modifying a small molecule comprising the following steps: (a) providing a cellulase, e.g., endoglucanase, cellobiohydrolase, beta-glucosidase, xylanase, mannanse, β-xylosidase, arabinofuranosidase, and/or oligomerase enzyme, wherein the enzyme comprises a polypeptide of the invention, or, a polypeptide encoded by a nucleic acid of the invention, or a subsequence thereof; (b) providing a small molecule; and (c) reacting the enzyme of step (a) with the small molecule of step (b) under conditions that facilitate an enzymatic reaction catalyzed by the cellulase, e.g., endoglucanase, cellobiohydrolase, beta-glucosidase, xylanase, mannanse, β-xylosidase, arabinofuranosidase, and/or oligomerase enzyme, thereby modifying a small molecule by a cellulase, e.g., endoglucanase, cellobiohydrolase, beta-glucosidase, xylanase, mannanse, β-xylosidase, arabinofuranosidase, and/or oligomerase enzymatic reaction. In one aspect, the method can comprise a plurality of small molecule substrates for the enzyme of step (a), thereby generating a library of modified small molecules produced by at least one enzymatic reaction catalyzed by the cellulase, e.g., endoglucanase, cellobiohydrolase, beta-glucosidase, xylanase, mannanse, β-xylosidase, arabinofuranosidase, and/or oligomerase enzyme. In one aspect, the method can comprise a plurality of additional enzymes under conditions that facilitate a plurality of biocatalytic reactions by the enzymes to form a library of modified small molecules produced by the plurality of enzymatic reactions. In another aspect, the method can further comprise the step of testing the library to determine if a particular modified small molecule that exhibits a desired activity is present within the library. The step of testing the library can further comprise the steps of systematically eliminating all but one of the biocatalytic reactions used to produce a portion of the plurality of the modified small molecules within the library by testing the portion of the modified small molecule for the presence or absence of the particular modified small molecule with a desired activity, and identifying at least one specific biocatalytic reaction that produces the particular modified small molecule of desired activity.

The invention provides methods for determining a functional fragment of an oligomerase and/or a cellulase, e.g., endoglucanase, cellobiohydrolase, beta-glucosidase, xylanase, mannanse, β-xylosidase, arabinofuranosidase, and/or oligomerase enzyme comprising the steps of: (a) providing a cellulase, e.g., endoglucanase, cellobiohydrolase, beta-glucosidase, xylanase, mannanse, β-xylosidase, arabinofuranosidase, and/or oligomerase enzyme, wherein the enzyme comprises a polypeptide of the invention, or a polypeptide encoded by a nucleic acid of the invention, or a subsequence thereof; and (b) deleting a plurality of amino acid residues from the sequence of step (a) and testing the remaining subsequence for cellulase, e.g., endoglucanase, cellobiohydrolase, beta-glucosidase, xylanase, mannanse, β-xylosidase, arabinofuranosidase, and/or oligomerase, enzyme activity, thereby determining a functional fragment of cellulase, e.g., endoglucanase, cellobiohydrolase, beta-glucosidase, xylanase, mannanse, β-xylosidase, arabinofuranosidase, and/or oligomerase, enzyme. In one aspect, the cellulase, e.g., endoglucanase, cellobiohydrolase, beta-glucosidase, xylanase, mannanse, β-xylosidase, arabinofuranosidase, and/or oligomerase enzyme activity is measured by providing a cellulase, e.g., endoglucanase, cellobiohydrolase, beta-glucosidase, xylanase, mannanse, β-xylosidase, arabinofuranosidase, and/or oligomerase enzyme substrate and detecting a decrease in the amount of the substrate or an increase in the amount of a reaction product.

The invention provides methods for whole cell engineering of new or modified phenotypes by using real-time metabolic flux analysis, the method comprising the following steps: (a) making a modified cell by modifying the genetic composition of a cell, wherein the genetic composition is modified by addition to the cell of a nucleic acid of the invention; (b) culturing the modified cell to generate a plurality of modified cells; (c) measuring at least one metabolic parameter of the cell by monitoring the cell culture of step (b) in real time; and, (d) analyzing the data of step (c) to determine if the measured parameter differs from a comparable measurement in an unmodified cell under similar conditions, thereby identifying an engineered phenotype in the cell using real-time metabolic flux analysis. In one aspect, the genetic composition of the cell can be modified by a method comprising deletion of a sequence or modification of a sequence in the cell, or, knocking out the expression of a gene. In one aspect, the method can further comprise selecting a cell comprising a newly engineered phenotype. In another aspect, the method can comprise culturing the selected cell, thereby generating a new cell strain comprising a newly engineered phenotype.

The invention provides methods of increasing thermotolerance or thermostability of oligomerase and/or a cellulase, e.g., endoglucanase, cellobiohydrolase, beta-glucosidase, xylanase, mannanse, β-xylosidase, arabinofuranosidase, and/or oligomerase enzyme polypeptide, the method comprising glycosylating a cellulase, e.g., endoglucanase, cellobiohydrolase, beta-glucosidase, xylanase, mannanse, β-xylosidase, arabinofuranosidase, and/or oligomerase enzyme polypeptide, wherein the polypeptide comprises at least thirty contiguous amino acids of a polypeptide of the invention; or a polypeptide encoded by a nucleic acid sequence of the invention, thereby increasing the thermotolerance or thermostability of the cellulase, e.g., endoglucanase, cellobiohydrolase, beta-glucosidase, xylanase, mannanse, β-xylosidase, arabinofuranosidase, and/or oligomerase polypeptide. In one aspect, the cellulase, e.g., endoglucanase, cellobiohydrolase, beta-glucosidase, xylanase, mannanse, β-xylosidase, arabinofuranosidase, and/or oligomerase enzyme specific activity can be thermostable or thermotolerant at a temperature in the range from greater than about 37° C. to about 95° C.

The invention provides methods for overexpressing a recombinant oligomerase and/or cellulase, e.g., endoglucanase, cellobiohydrolase, beta-glucosidase, xylanase, mannanse, β-xylosidase, arabinofuranosidase, and/or oligomerase polypeptide in a cell comprising expressing a vector comprising a nucleic acid comprising a nucleic acid of the invention or a nucleic acid sequence of the invention, wherein the sequence identities are determined by analysis with a sequence comparison algorithm or by visual inspection, wherein overexpression is effected by use of a high activity promoter, a dicistronic vector or by gene amplification of the vector.

The invention provides methods of making a transgenic plant comprising the following steps: (a) introducing a heterologous nucleic acid sequence into the cell, wherein the heterologous nucleic acid sequence comprises a nucleic acid sequence of the invention, thereby producing a transformed plant cell; and (b) producing a transgenic plant from the transformed cell. In one aspect, the step (a) can further comprise introducing the heterologous nucleic acid sequence by electroporation or microinjection of plant cell protoplasts. In another aspect, the step (a) can further comprise introducing the heterologous nucleic acid sequence directly to plant tissue by DNA particle bombardment. Alternatively, the step (a) can further comprise introducing the heterologous nucleic acid sequence into the plant cell DNA using an *Agrobacterium tumefaciens* host. In one aspect, the plant cell can be a cane sugar, beet, soybean, tomato, potato, corn, rice, wheat, tobacco or barley cell.

The invention provides methods of expressing a heterologous nucleic acid sequence in a plant cell comprising the following steps: (a) transforming the plant cell with a heterologous nucleic acid sequence operably linked to a promoter, wherein the heterologous nucleic sequence comprises a nucleic acid of the invention; (b) growing the plant under conditions wherein the heterologous nucleic acids sequence is expressed in the plant cell. The invention provides methods of expressing a heterologous nucleic acid sequence in a plant cell comprising the following steps: (a) transforming the plant cell with a heterologous nucleic acid sequence operably linked to a promoter, wherein the heterologous nucleic sequence comprises a sequence of the invention; (b) growing the plant under conditions wherein the heterologous nucleic acids sequence is expressed in the plant cell.

The invention provides methods for hydrolyzing, breaking up or disrupting a cellooligsaccharide, an arabinoxylan oligomer, or a glucan- or cellulose-comprising composition comprising the following steps: (a) providing a polypeptide of the invention having an oligomerase, a cellulase or a cellulolytic activity; (b) providing a composition comprising a cellulose or a glucan; and (c) contacting the polypeptide of step (a) with the composition of step (b) under conditions wherein the cellulase hydrolyzes, breaks up or disrupts the cellooligsaccharide, arabinoxylan oligomer, or glucan- or cellulose-comprising composition; wherein optionally the composition comprises a plant cell, a bacterial cell, a yeast cell, an insect cell, or an animal cell, and optionally the polypeptide has oligomerase, endoglucanase, cellobiohydrolase, beta-glucosidase, xylanase, mannanse, β-xylosidase, arabinofuranosidase, and/or oligomerase activity.

The invention provides feeds or foods comprising a polypeptide of the invention, or a polypeptide encoded by a nucleic acid of the invention. In one aspect, the invention provides a food, feed, a liquid, e.g., a beverage (such as a fruit juice or a beer), a bread or a dough or a bread product, or a beverage precursor (e.g., a wort), comprising a polypeptide of the invention. The invention provides food or nutritional supplements for an animal comprising a polypeptide of the invention, e.g., a polypeptide encoded by the nucleic acid of the invention.

In one aspect, the polypeptide in the food or nutritional supplement can be glycosylated. The invention provides edible enzyme delivery matrices comprising a polypeptide of the invention, e.g., a polypeptide encoded by the nucleic acid of the invention. In one aspect, the delivery matrix comprises a pellet. In one aspect, the polypeptide can be glycosylated. In one aspect, the cellulase, e.g., endoglucanase, cellobiohydrolase, beta-glucosidase, xylanase, mannanse, β-xylosidase, arabinofuranosidase, and/or oligomerase enzyme activity is thermotolerant. In another aspect, the cellulase, e.g., endoglucanase, cellobiohydrolase, beta-glucosidase, xylanase, mannanse, β-xylosidase, arabinofuranosidase, and/or oligomerase enzyme activity is thermostable.

The invention provides a food, a feed or a nutritional supplement comprising a polypeptide of the invention. The invention provides methods for utilizing a cellulase, e.g., endoglucanase, cellobiohydrolase, beta-glucosidase, xylanase, mannanse, β-xylosidase, arabinofuranosidase, and/or oligomerase enzyme as a nutritional supplement in an animal diet, the method comprising: preparing a nutritional supplement containing a cellulase, e.g., endoglucanase, cellobiohydrolase, beta-glucosidase, xylanase, mannanse, β-xylosidase, arabinofuranosidase, and/or oligomerase enzyme comprising at least thirty contiguous amino acids of a polypeptide of the invention; and administering the nutritional supplement to an animal. The animal can be a human, a ruminant or a monogastric animal. The cellulase, e.g., endoglucanase, cellobiohydrolase, beta-glucosidase, xylanase, mannanse, β-xylosidase, arabinofuranosidase, and/or oligomerase enzyme can be prepared by expression of a polynucleotide encoding the cellulase, e.g., endoglucanase, cellobiohydrolase, beta-glucosidase, xylanase, mannanse, β-xylosidase, arabinofuranosidase, and/or oligomerase enzyme in an organism selected from the group consisting of a bacterium, a yeast, a plant, an insect, a fungus and an animal. The organism can be selected from the group consisting of an *S. pombe, S. cerevisiae, Pichia pastoris, E. coli, Streptomyces* sp., *Bacillus* sp. and *Lactobacillus* sp.

The invention provides edible enzyme delivery matrix comprising a thermostable recombinant cellulase, e.g., endoglucanase, cellobiohydrolase, beta-glucosidase, xylanase, mannanse, β-xylosidase, arabinofuranosidase, and/or oligomerase enzyme, e.g., a polypeptide of the invention. The invention provides methods for delivering a cellulase, e.g., endoglucanase, cellobiohydrolase, beta-glucosidase, xylanase, mannanse, β-xylosidase, arabinofuranosidase, and/or oligomerase enzyme supplement to an animal, the method comprising: preparing an edible enzyme delivery matrix in the form of pellets comprising a granulate edible carrier and a thermostable recombinant cellulase, e.g., endoglucanase, cellobiohydrolase, beta-glucosidase, xylanase, mannanse, β-xylosidase, arabinofuranosidase, and/or oligomerase enzyme, wherein the pellets readily disperse the cellulase, e.g., endoglucanase, cellobiohydrolase, beta-glucosidase, xylanase, mannanse, β-xylosidase, arabinofuranosidase, and/or oligomerase enzyme contained therein into aqueous media, and administering the edible enzyme delivery matrix to the animal. The recombinant cellulase, e.g., endoglucanase, cellobiohydrolase, beta-glucosidase, xylanase, mannanse, β-xylosidase, arabinofuranosidase, and/or oligomerase enzyme can comprise a polypeptide of the invention. The cellulase, e.g., endoglucanase, cellobiohydrolase, beta-glucosidase, xylanase, mannanse, β-xylosidase, arabinofuranosidase, and/or oligomerase enzyme can be glycosylated to provide thermostability at pelletizing conditions. The delivery matrix can be formed by pelletizing a mixture comprising a grain germ and a cellulase, e.g., endoglucanase, cellobiohydrolase, beta-glucosidase, xylanase, mannanse, β-xylosidase, arabinofuranosidase, and/or oligomerase enzyme. The pelletizing conditions can include application of steam. The pelletizing conditions can comprise application of a temperature in excess of about 80° C. for about 5 minutes and the enzyme retains a specific activity of at least 350 to about 900 units per milligram of enzyme.

In one aspect, invention provides a pharmaceutical composition comprising a cellulase, e.g., endoglucanase, cellobiohydrolase, beta-glucosidase, xylanase, mannanse, β-xylosidase, arabinofuranosidase, and/or oligomerase enzyme of the invention, or a polypeptide encoded by a nucleic acid of the invention. In one aspect, the pharmaceutical composition acts as a digestive aid.

In certain aspects, a cellulose-containing compound is contacted a polypeptide of the invention having a cellulase, e.g., endoglucanase, cellobiohydrolase, beta-glucosidase, xylanase, mannanse, β-xylosidase, arabinofuranosidase, and/or oligomerase enzyme activity at a pH in the range of between about pH 3.0 to 9.0, 10.0, 11.0 or more. In other aspects, a cellulose-containing compound is contacted with the cellulase, e.g., endoglucanase, cellobiohydrolase, beta-glucosidase, xylanase, mannanse, β-xylosidase, arabinofuranosidase, and/or oligomerase enzyme at a temperature of about 55° C., 60° C., 65° C., 70° C., 75° C., 80° C., 85° C., 90° C., or more.

The invention provides methods for delivering an oligomerase and/or a cellulase supplement to an animal, the method comprising: preparing an edible enzyme delivery matrix or pellets comprising a granulate edible carrier and a thermostable recombinant cellulase enzyme, wherein the pellets readily disperse the cellulase enzyme contained therein into aqueous media, and the recombinant cellulase enzyme comprises a polypeptide of the invention, or a polypeptide encoded by a nucleic acid of the invention; and, administering the edible enzyme delivery matrix or pellet to the animal; and optionally the granulate edible carrier comprises a carrier selected from the group consisting of a grain germ, a grain germ that is spent of oil, a hay, an alfalfa, a timothy, a soy hull, a sunflower seed meal and a wheat midd, and optionally the edible carrier comprises grain germ that is spent of oil, and optionally the cellulase enzyme is glycosylated to provide thermostability at pelletizing conditions, and optionally the delivery matrix is formed by pelletizing a mixture comprising a grain germ and a cellulase, and optionally the pelletizing conditions include application of steam, and optionally the pelletizing conditions comprise application of a temperature in excess of about 80° C. for about 5 minutes and the enzyme retains a specific activity of at least 350 to about 900 units per milligram of enzyme.

The invention provides cellulose- or cellulose derivative-compositions comprising a polypeptide of the invention, or a polypeptide encoded by a nucleic acid of the invention, wherein optionally the polypeptide has an oligomerase, cellulase, endoglucanase, cellobiohydrolase, beta-glucosidase, xylanase, mannanse, β-xylosidase, arabinofuranosidase, and/or oligomerase activity.

The invention provides wood, wood pulp or wood products comprising a cellulose of the invention, or a cellulase encoded by a nucleic acid of the invention, wherein optionally the cellulase activity comprises endoglucanase, cellobiohydrolase, beta-glucosidase, xylanase, mannanse, β-xylosidase, arabinofuranosidase, and/or oligomerase activity.

The invention provides paper, paper pulp or paper products comprising a polypeptide of the invention, or a polypeptide encoded by a nucleic acid of the invention, wherein optionally the polypeptide has cellulase, endoglucanase, cellobiohydrolase, beta-glucosidase, xylanase, mannanse, β-xylosidase, arabinofuranosidase, and/or oligomerase activity.

The invention provides methods for reducing the amount of cellulose in a paper, a wood or wood product comprising contacting the paper, wood or wood product with a cellulase of the invention, or a cellulase encoded by a nucleic acid of the invention, wherein optionally the cellulase activity comprises endoglucanase, cellobiohydrolase, beta-glucosidase, xylanase, mannanse, β-xylosidase, arabinofuranosidase, and/or oligomerase activity.

The invention provides detergent compositions comprising a cellulase of the invention, or a cellulase encoded by a nucleic acid of the invention, wherein optionally the polypeptide is formulated in a non-aqueous liquid composition, a cast solid, a granular form, a particulate form, a compressed tablet, a gel form, a paste or a slurry form, and optionally the cellulase activity comprises endoglucanase, cellobiohydrolase, beta-glucosidase, xylanase, mannanse, β-xylosidase, arabinofuranosidase, and/or oligomerase activity.

The invention provides pharmaceutical compositions or dietary supplements comprising a cellulase of the invention, or a cellulase encoded by a nucleic acid of the invention, wherein optionally the cellulase is formulated as a tablet, gel, pill, implant, liquid, spray, powder, food, feed pellet or as an encapsulated formulation and optionally the cellulase activity comprises endoglucanase, cellobiohydrolase, beta-glucosidase, xylanase, mannanse, β-xylosidase, arabinofuranosidase, and/or oligomerase activity.

The invention provides fuels comprising a polypeptide of the invention, or a polypeptide encoded by a nucleic acid of the invention, wherein optionally the polypeptide has activity comprising cellulase, endoglucanase, cellobiohydrolase, beta-glucosidase, xylanase, mannanse, β-xylosidase, arabinofuranosidase, and/or oligomerase activity, wherein optionally the fuel is derived from a plant material, which optionally comprises potatoes, soybean (rapeseed), barley, rye, corn, oats, wheat, beets or sugar cane, and optionally the fuel comprises a bioethanol or a gasoline-ethanol mix.

The invention provides methods for making a fuel comprising contacting a composition comprising a cellulose or a fermentable sugar with a polypeptide of the invention, or a polypeptide encoded by a nucleic acid of the invention, or any one of the mixtures or "cocktails" or products of manufacture of the invention, wherein optionally the composition comprising a cellulose or a fermentable sugar comprises a plant, plant product or plant derivative, and optionally the plant or plant product comprises cane sugar plants or plant products, beets or sugarbeets, wheat, corn, soybeans, potato, rice or barley, and optionally the polypeptide has activity comprising cellulase, endoglucanase, cellobiohydrolase, beta-glucosidase, xylanase, mannanse, β-xylosidase, arabinofuranosidase, and/or oligomerase activity, and optionally the fuel comprises a bioethanol or a gasoline-ethanol mix.

The invention provides methods for making bioethanol comprising contacting a composition comprising a cellulose or a fermentable sugar with a polypeptide of the invention, or a polypeptide encoded by a nucleic acid of the invention, or any one of the mixtures or "cocktails" or products of manufacture of the invention, wherein optionally the composition comprising a cellulose or a fermentable sugar comprises a plant, plant product or plant derivative, and optionally the plant or plant product comprises cane sugar plants or plant products, beets or sugarbeets, wheat, corn, soybeans, potato, rice or barley, and optionally the polypeptide has activity comprising cellulase, endoglucanase, cellobiohydrolase, beta-glucosidase, xylanase, mannanse, β-xylosidase, arabinofuranosidase, and/or oligomerase activity.

The invention provides enzyme ensembles, or "cocktail", for depolymerization of cellulosic and hemicellulosic polymers to metabolizeable carbon moieties comprising a polypeptide of the invention, or a polypeptide encoded by a nucleic acid of the invention, wherein optionally the polypeptide has activity comprising cellulase, endoglucanase, cellobiohydrolase, beta-glucosidase, xylanase, mannanse, β-xylosidase, arabinofuranosidase, and/or oligomerase activity. The enzyme ensembles, or "cocktails", of the invention can be in the form of a composition (e.g., a formulation, liquid or solid), e.g., as a product of manufacture.

The invention provides compositions (including products of manufacture, enzyme ensembles, or "cocktails") comprising (a) a mixture (or "cocktail") of hemicellulose- and cellulose-hydrolyzing enzymes, wherein the cellulose-hydrolyzing enzymes comprise at least one of each of a endoglucanase, cellobiohydrolase I (CBH I), cellobiohydrolase II (CBH II) and β-glucosidase; and the hemicellulose-hydrolyzing enzymes comprise at least one of each of an xylanase, β-xylosidase and arabinofuranosidase; (b) a mixture (or "cocktail") of hemicellulose- and cellulose-hydrolyzing enzymes comprising at least one of each of a endoglucanase, oligomerase, cellobiohydrolase I (CBH I), cellobiohydrolase II (CBH II), arabinofuranosidase and xylanase, wherein optionally the oligomerase is an oligomerase-1 or β-glucosidase, or an optionally the oligomerase is an oligomerase-2 or β-xylosidase; (c) a mixture (or "cocktail") of hemicellulose- and cellulose-hydrolyzing enzymes comprising at least one of each of a endoglucanase; a cellobiohydrolase I (CBH I); a cellobiohydrolase II (CBH II); an arabinofuranosidase; a xylanase; an oligomerase-1 a β-glucosidase; and, an oligomerase-2 or β-xylosidase; or (d) a mixture (or "cocktail") of enzymes comprising (1) an endoglucanase which cleaves internal β-1,4 linkages resulting in shorter glucooligosaccharides, (2) a cellobiohydrolase which acts in an "exo" manner processively releasing cellobiose units (β-1,4 glucose-glucose disaccharide), and (3) a β-glucosidase for releasing glucose monomer from short cellooligosaccharides (e.g. cellobiose).

In alternative aspects of the compositions (e.g., enzyme ensembles, or products of manufacture) of the invention (a) the endoglucanase comprises SEQ ID NO:106, the cellobiohydrolase I comprises SEQ ID NO:34 or SEQ ID NO:46, the cellobiohydrolase II comprises SEQ ID NO:98, the β-glucosidase comprises SEQ ID NO:94, the xylanase comprises SEQ ID NO:100, SEQ ID NO:102 or SEQ ID NO:524, the β-xylosidase comprises SEQ ID NO:96, the arabinofuranosidase comprises SEQ ID NO:92 or SEQ ID NO:104, or any combination thereof, wherein SEQ ID NO:106 optionally comprises an additional carbohydrate binding domain; or (b) the mixture comprises an endoglucanase comprising SEQ ID NO:106, an oligomerase-1 comprising SEQ ID NO:522, a cellobiohydrolase I (CBH I) comprising SEQ ID NO:34 or SEQ ID NO:46, a cellobiohydrolase II (CBH II) comprising SEQ ID NO:98, an arabinofuranosidase comprising SEQ ID NO:92, an oligomerase-2 (or β-xylosidase) comprising SEQ ID NO:520, and a xylanase comprising SEQ ID NO:524 or SEQ ID NO:100.

The invention provides compositions or products of manufacture comprising a mixture of enzymes comprising (a) SEQ ID NO:106, a cellobiohydrolase I (CBH I), and a cellobiohydrolase II (CBH II); (b) the mixture of (a), wherein the CBHI is SEQ ID NO:46 or SEQ ID NO:34; (c) the mixture of (a) or (b), wherein the CBHII is SEQ ID NO:98; (d) the mixture of (a), (b), or (c), further comprising an arabinofuranosidase; (e) the mixture of (d), wherein the arabinofuranosidase is SEQ ID NO:92 and/or SEQ ID NO:104; (f) the mixture of (a), (b), (c), (d) or (e), further comprising a xylanase; (g) the mixture of (f), wherein the xylanase is SEQ ID NO:100, SEQ ID NO:102 or SEQ ID NO:524, or a combination thereof; (h) the mixture of (a), (b), (c), (d), (e), (f) or (g), further comprising an oligomerase; (i) the mixture of (h), wherein the oligomerase is SEQ ID NO:520 or SEQ ID NO:522, or a combination thereof; (j) the mixture of (a), (b), (c), (d), (e), (f), (g), (h) or (i), further comprising at least one of SEQ ID NO:94, SEQ ID NO:96, SEQ ID NO:264, SEQ ID NO:440 or SEQ ID NO:442, or a combination thereof; or (k) the mixture of (a), (b), (c), (d), (e), (f), (g), (h), (i), or (j), further comprising an endoglucanase, wherein optionally the endoglucanase comprises SEQ ID NO:108, SEQ ID NO:112, SEQ ID NO:114, or SEQ ID NO:116.

The invention provides methods for processing a biomass material comprising lignocellulose comprising contacting a composition comprising a cellulose or a fermentable sugar with a polypeptide of the invention, or a polypeptide encoded by a nucleic acid of the invention, or an enzyme ensemble, product of manufacture or "cocktail" of the invention, wherein optionally the biomass material comprising lignocellulose is derived from an agricultural crop, is a byproduct of a food or a feed production, is a lignocellulosic waste product, or is a plant residue or a waste paper or waste paper product, and optionally the polypeptide has activity comprising cellulase, endoglucanase, cellobiohydrolase, beta-glucosidase, xylanase, mannanse, β-xylosidase, arabinofuranosidase, and/or oligomerase activity, and optionally the plant residue comprise grain, seeds, stems, leaves, hulls, husks, corn cobs, corn stover, straw, grasses, wherein optionally grasses are Indian grass or switch grass, wood, wood chips, wood pulp and sawdust, and optionally the paper waste comprises discarded or used photocopy paper, computer printer paper, notebook paper, notepad paper, typewriter paper, newspapers, magazines, cardboard and paper-based packaging materials, and optionally the processing of the biomass material generates a bioethanol.

The invention provides dairy products comprising a polypeptide of the invention, or a polypeptide encoded by a nucleic acid of the invention, or an enzyme ensemble, product of manufacture or "cocktail" of the invention, wherein optionally the dairy product comprises a milk, an ice cream, a cheese or a yoghurt, and optionally the polypeptide has activity comprising oligomerase and/or cellulase, endoglucanase, cellobiohydrolase, beta-glucosidase, xylanase, mannanse, β-xylosidase, arabinofuranosidase, and/or oligomerase activity.

The invention provides method for improving texture and flavor of a dairy product comprising the following steps: (a) providing a polypeptide of the invention, or a polypeptide encoded by a nucleic acid of the invention, or an enzyme ensemble, product of manufacture or "cocktail" of the invention; (b) providing a dairy product; and (c) contacting the polypeptide of step (a) and the dairy product of step (b) under conditions wherein the cellulase can improve the texture or flavor of the dairy product.

The invention provides textiles or fabrics comprising a polypeptide of the invention, or a polypeptide encoded by a nucleic acid of the invention, or an enzyme ensemble, product of manufacture or "cocktail" of the invention, wherein optionally the textile or fabric comprises a cellulose-containing fiber, and optionally the polypeptide has activity comprising oligomerase and/or cellulase, endoglucanase, cellobiohydrolase, beta-glucosidase, xylanase, mannanse, β-xylosidase, arabinofuranosidase, and/or oligomerase activity.

The invention provides methods for treating solid or liquid animal waste products comprising the following steps: (a) providing a polypeptide of the invention, or a polypeptide encoded by a nucleic acid of the invention, or an enzyme ensemble, product of manufacture or "cocktail" of the invention, wherein optionally the polypeptide has activity comprising oligomerase and/or cellulase, endoglucanase, cellobiohydrolase, beta-glucosidase, xylanase, mannanse, β-xylosidase, arabinofuranosidase, and/or oligomerase activity; (b) providing a solid or a liquid animal waste; and (c) contacting the polypeptide of step (a) and the solid or liquid waste of step (b) under conditions wherein the protease can treat the waste.

The invention provides processed waste products comprising a polypeptide of the invention, or a polypeptide encoded by a nucleic acid of the invention, or an enzyme ensemble, product of manufacture or "cocktail" of the invention, wherein optionally the polypeptide has activity comprising oligomerase and/or cellulase, endoglucanase, cellobiohydrolase, beta-glucosidase, xylanase, mannanse, β-xylosidase, arabinofuranosidase, and/or oligomerase activity.

The invention provides disinfectants comprising a polypeptide having oligomerase and/or cellulase activity, wherein the polypeptide comprises a sequence of the invention, or a polypeptide encoded by a nucleic acid of the invention, or an enzyme ensemble, product of manufacture or "cocktail" of the invention, wherein optionally the polypeptide has activity comprising endoglucanase, cellobiohydrolase, beta-glucosidase, xylanase, mannanse, β-xylosidase, arabinofuranosidase, and/or oligomerase activity.

The invention provides biodefense or bio-detoxifying agents comprising a polypeptide having oligomerase and/or cellulase activity, wherein the polypeptide comprises a sequence of the invention, or a polypeptide encoded by a nucleic acid of the invention, or an enzyme ensemble, product of manufacture or "cocktail" of the invention, wherein optionally the polypeptide has activity comprising endoglucanase, cellobiohydrolase, beta-glucosidase, xylanase, mannanse, β-xylosidase, arabinofuranosidase, and/or oligomerase activity.

The invention provides compositions (including enzyme ensembles and products of manufacture of the invention) comprising a mixture of hemicellulose- and cellulose-hydrolyzing enzymes, wherein the cellulose-hydrolyzing enzymes comprise at least one endoglucanase, cellobiohydrolase I, cellobiohydrolase II and β-glucosidase; and the hemicellulose-hydrolyzing enzymes comprise at least one xylanase, β-xylosidase and arabinofuranosidase. In one aspect, the endoglucanase is EG1_CDCBM3 (SEQ ID NO:106 (encoded by, e.g., SEQ ID NO:105) plus a carbohydrate binding domain), the cellobiohydrolase I (CBH I) is SEQ ID NO:34 (encoded by, e.g., SEQ ID NO: 33) or SEQ ID NO:46 (encoded by, e.g., SEQ ID NO:45), the cellobiohydrolase II is SEQ ID NO:98 (encoded by, e.g., SEQ ID NO:97), the β-glucosidase is SEQ ID NO:94 (encoded by, e.g., SEQ ID NO:93), the xylanase is SEQ ID NO:100 (encoded by, e.g., SEQ ID NO:99), SEQ ID NO:102 (encoded by, e.g., SEQ ID NO:01) or SEQ ID NO:524 (encoded by, e.g., SEQ ID NO:523), the β-xylosidase is SEQ ID NO:96 (encoded by, e.g., SEQ ID NO:95), the arabinofuranosidase is SEQ ID NO:92 (encoded by, e.g., SEQ ID NO:91) or SEQ ID NO:104 (encoded by, e.g., SEQ ID NO:103), or a combination thereof.

The invention provides compositions (including enzyme ensembles and products of manufacture of the invention) comprising (a) SEQ ID NO:106, SEQ ID NO:264, a cellobiohydrolase I (CBH I), a cellobiohydrolase II (CBH II), SEQ ID NO:100 or SEQ ID NO:524, SEQ ID NO:96, SEQ ID NO:92, SEQ ID NO:440 and SEQ ID NO:442; or (b) SEQ ID NO:106, SEQ ID NO:264, SEQ ID NO:34 or SEQ ID NO:46, SEQ ID NO:98, SEQ ID NO:100 or SEQ ID NO:524, SEQ ID NO:96, SEQ ID NO:92, SEQ ID NO:440, SEQ ID NO:442 and SEQ ID NO:102; (c) SEQ ID NO:98; SEQ ID NO:34 or SEQ ID NO:46; SEQ ID NO:94; SEQ ID NO:100 or SEQ ID NO:524; SEQ ID NO:102; SEQ ID NO:96; SEQ ID NO:92; and, SEQ ID NO:104; or, (d) the mixture of (a), (b) or (c) further comprising an endoglucanase, wherein optionally the endoglucanase comprises SEQ ID NO:108, SEQ ID NO:108, SEQ ID NO:112, SEQ ID NO:114, or SEQ ID NO:116.

The invention provides compositions (including enzyme ensembles and products of manufacture of the invention) comprising a mixture of hemicellulose- and cellulose-hydrolyzing enzymes of the invention, and a biomass material, wherein optionally the biomass material comprises a lignocellulosic material derived from an agricultural crop, or the biomass material is a byproduct of a food or a feed production, or the biomass material is a lignocellulosic waste product, or the biomass material is a plant residue or a waste paper or waste paper product, or the biomass material comprises a plant residue, and optionally the plant residue comprises grains, seeds, stems, leaves, hulls, husks, corn cobs, corn stover, grasses, wherein optionally grasses are Indian grass or switch grass, straw, wood, wood chips, wood pulp and/or sawdust, and optionally the paper waste comprises discarded or used photocopy paper, computer printer paper, notebook paper, notepad paper, typewriter paper, newspapers, magazines, cardboard and paper-based packaging materials.

The invention provides methods for processing a biomass material comprising providing enzyme ensembles ("cocktails") or products of manufacture of the invention, or a mixture of hemicellulose- and cellulose-hydrolyzing enzymes, wherein the cellulose-hydrolyzing enzymes comprise at least one endoglucanase, cellobiohydrolase I, cellobiohydrolase II and β-glucosidase; and the hemicellulose-hydrolyzing enzymes comprise at least one xylanase, β-xylosidase and arabinofuranosidase, and contacting the mixture of enzymes with the biomass material, wherein optionally the biomass material comprising lignocellulose is derived from an agricultural crop, is a byproduct of a food or a feed production, is a lignocellulosic waste product, or is a plant residue or a waste paper or waste paper product, and optionally the polypeptide has activity comprising cellulase, endoglucanase, cellobiohydrolase, beta-glucosidase, xylanase, mannanse, β-xylosidase, arabinofuranosidase, and/or oligomerase activity, and optionally the plant residue comprise grains, seeds, stems, leaves, hulls, husks, corn cobs, corn stover, grasses, wherein optionally grasses are Indian grass or switch grass, straw, wood, wood chips, wood pulp and sawdust, and optionally the paper waste comprises discarded or used photocopy paper, computer printer paper, notebook paper, notepad paper, typewriter paper, newspapers, magazines, cardboard and paper-based packaging materials, and optionally the processing of the biomass material generates a bioethanol. In one aspect, the endoglucanase is EG1_CDCBM3 (SEQ ID NO:106 (encoded by, e.g., SEQ ID NO:105) plus a carbohydrate binding domain), the cellobiohydrolase I is SEQ ID NO:34 (encoded by, e.g., SEQ ID NO:33) or SEQ ID NO:46 (encoded by, e.g., SEQ ID NO:45), the cellobiohydrolase II is SEQ ID NO:98 (encoded by, e.g., SEQ ID NO:97), the β-glucosidase is SEQ ID NO:94 (encoded by, e.g., SEQ ID NO:93), the xylanase is SEQ ID NO:100 (encoded by, e.g., SEQ ID NO:99) or SEQ ID NO:102 (encoded by, e.g., SEQ ID NO:101) or SEQ ID NO:524 (encoded by, e.g., SEQ ID NO:523), the β-xylosidase is SEQ ID NO:96 (encoded by, e.g., SEQ ID NO:95), the arabinofuranosidase is SEQ ID NO:92 (encoded by, e.g., SEQ ID NO:91) or SEQ ID NO:104 (encoded by, e.g., SEQ ID NO:103), or a combination thereof.

The invention provides compositions (including enzyme ensembles ("cocktails") or products of manufacture of the invention) comprising a mixture of enzymes comprising SEQ ID NO:106 (encoded by, e.g., SEQ ID NO:105), SEQ ID NO:264 (encoded by, e.g., SEQ ID NO:263), a cellobiohydrolase I (CBH I), a cellobiohydrolase II (CBH II), SEQ ID NO:100 (encoded by, e.g., SEQ ID NO:99) or SEQ ID NO:524 (encoded by, e.g., SEQ ID NO:523), SEQ ID NO:96 (encoded by, e.g., SEQ ID NO:95), SEQ ID NO:92 (encoded by, e.g., SEQ ID NO:91), SEQ ID NO:440 (encoded by, e.g., SEQ ID NO:439) and SEQ ID NO:442 (encoded by, e.g., SEQ ID NO:441). In one aspect, the mixture of enzymes comprises SEQ ID NO:34 (encoded by, e.g., SEQ ID NO:33), SEQ ID NO:98 (encoded by, e.g., SEQ ID NO:97) and SEQ ID NO:104 (encoded by, e.g., SEQ ID NO:103).

The invention provides methods for processing a biomass material comprising providing a mixture of enzymes of the invention (including enzyme ensembles ("cocktails") or products of manufacture of the invention), and contacting the enzyme mixture with the biomass material, wherein optionally the biomass material comprising lignocellulose is derived from an agricultural crop, is a byproduct of a food or a feed production, is a lignocellulosic waste product, or is a plant residue or a waste paper or waste paper product, and optionally the polypeptide has activity comprising cellulase, endoglucanase, cellobiohydrolase, beta-glucosidase, xylanase, mannanase, β-xylosidase, arabinofuranosidase, and/or oligomerase activity, and optionally the plant residue comprise seeds, stems, leaves, hulls, husks, corn cobs, corn stover, grasses, wherein optionally grasses are Indian grass or switch grass, grains, straw, wood, wood chips, wood pulp and sawdust, and optionally the paper waste comprises discarded or used photocopy paper, computer printer paper, notebook paper, notepad paper, typewriter paper, newspapers, magazines, cardboard and paper-based packaging materials, and optionally the processing of the biomass material generates a bioethanol.

The invention provides chimeric polypeptides comprising a first domain and at least a second domain, wherein the first domain comprises an enzyme of the invention, and the second domain comprises a heterologous or modified carbohydrate binding domain or a heterologous or modified dockerin domain, and optionally the carbohydrate binding domain is a cellulose-binding module (CBM) or a lignin-binding domain, and optionally the second domain appended approximate to the enzyme's catalytic domain, and optionally the second domain appended approximate to the C-terminus of the enzyme's catalytic domain.

The invention provides compositions comprising an polypeptide having a cellobiohydrolase I activity and a polypeptide having arabinofuranosidase activity, wherein at least one polypeptide having a cellobiohydrolase I activity is SEQ ID NO:34 (encoded by, e.g., SEQ ID NO:33).

The details of one or more aspects of the invention are set forth in the accompanying drawings and the description below. Other features, objects, and advantages of the invention will be apparent from the description and drawings, and from the claims.

All publications, patents, patent applications, GenBank sequences and ATCC deposits, cited herein are hereby expressly incorporated by reference for all purposes.

BRIEF DESCRIPTION OF DRAWINGS

The following drawings are illustrative of aspects of the invention and are not meant to limit the scope of the invention as encompassed by the claims.

The patent or application file contains at least one drawing executed in color. Copies of this patent or patent application publication with color drawing(s) will be provided by the Office upon request and payment of the necessary fee.

FIG. 14 is a technology comparison illustrating the difference between screening using the GIGAMATRIX™ Platform vs. traditional 384-well plates

FIG. 21 illustrates data showing the release of glucose at 48 h from pretreated corn stover samples by 20 different endoglucanases, as discussed in detail in Example 5, below.

FIG. 26 illustrates data showing the performance of exemplary enzyme cocktails of the invention on low severity alk-PCS and alkaline pretreated cobs, as discussed in detail in Example 5, below.

FIG. 27 in table form compares data from SPEZYME® cellulase the exemplary enzyme cocktail of the invention E9 on four different pretreated corn samples, as discussed in detail in Example 5, below.

FIG. 28 in table form sets forth data of specific activity of EGs on soluble cellulose substrate carboxylmethyl cellulose (CMC) at determined at 37° C., pH 7.0; as discussed in detail in Example 8, below.

FIG. 29 illustrates the hydrolysis of AVICEL® by exemplary EGs under normalized conditions at 60° C.

FIGS. 57 to 59 summarizes in table form the compositions of exemplary enzyme mixes of the invention: FIG. 57 (Case 1—CBH I/CBH II), FIG. 58 (Case 2—CBH I/SEQ ID NO:98 (encoded by, e.g., SEQ ID NO:97)), and FIG. 59 (Case 3—SEQ ID NO: 34 (encoded by, e.g., SEQ ID NO:33)/SEQ ID NO:98 (encoded by, e.g., SEQ ID NO:97)); as discussed in detail in Example 10, below.

FIG. 83 graphically illustrates data showing activity of exemplary enzymes of the invention is dependent upon number of days in a shake flask.

FIG. 84 graphically illustrates data showing the progression of percent conversion as different enzymes of the invention were combined; and the figure describes exemplary enzyme mixtures of the invention, e.g., E10, E9, etc.; the figure graphically illustrates the improvement in glucose and xylose conversion as enzymes of the invention are added to the cocktail; as discussed in detail in Example 12, below.

FIG. 85 graphically illustrates digestion of pretreated biomass feedstocks by SPEZYME® enzyme and the exemplary enzyme mix of the invention designated "E9", by showing the amount of sugar released at 48 hrs.

Like reference symbols in the various drawings indicate like elements.

DETAILED DESCRIPTION

Figure 1:
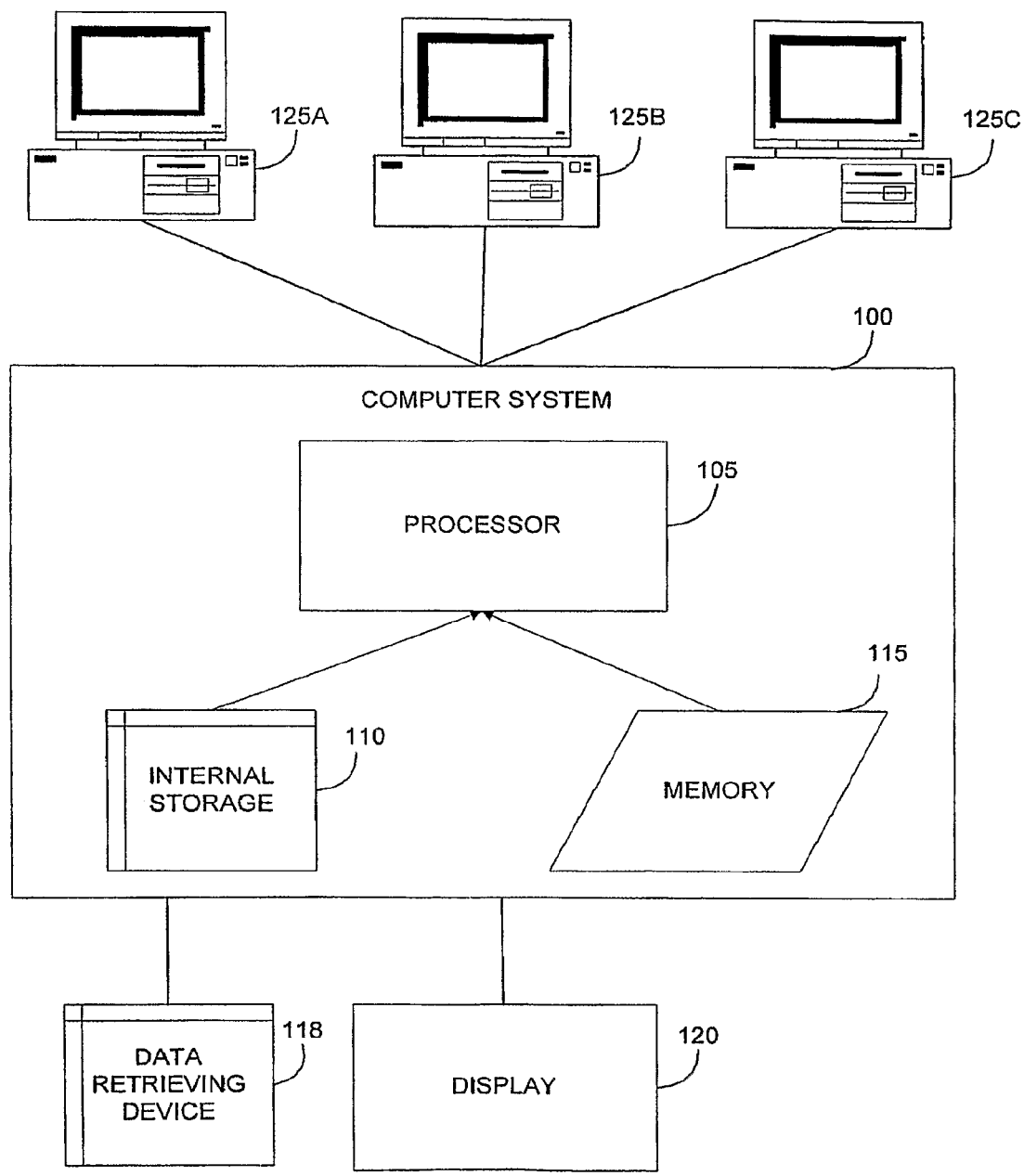
FIG. 1 is a block diagram of a computer system.

In one aspect, the invention provides polypeptides having any cellulolytic activity, e.g., a cellulase activity, e.g., endoglucanase, cellobiohydrolase, mannanase and/or β-glucosidase activity, polynucleotides encoding these polypeptides, and methods of making and using these polynucleotides and polypeptides. In one aspect, the invention provides polypeptides having an oligomerase activity, e.g., enzymes that convert soluble oligomers to fermentable monomeric sugars in the saccharification of biomass, e.g., where the activity comprises enzymatic hydrolysis of (to degrade) soluble cellooligsaccharides and arabinoxylan oligomers into monomer xylose, arabinose and glucose; and polynucleotides encoding these enzymes, and making and using these polynucleotides and polypeptides. In one aspect, the invention provides thermostable and thermotolerant forms of polypeptides of the invention. The polypeptides of the invention can be used in a variety of pharmaceutical, agricultural and industrial contexts.

In one aspect, the invention provides a cellulase, e.g., endoglucanase, cellobiohydrolase, beta-glucosidase, xylanase, mannanse, β-xylosidase, arabinofuranosidase, and/or oligomerase, with an increased catalytic rate, improving the process of substrate hydrolysis. This increased efficiency in catalytic rate leads to an increased efficiency in producing sugars that will subsequently be used by microorganisms for ethanol production. In one aspect, microorganisms generating enzyme of the invention are used with ethanol-producing microorganisms. Thus, the invention provides methods for ethanol production and making "clean fuels" based on ethanol, e.g., for transportation using bioethanol.

In one aspect the invention provides compositions (e.g., enzyme preparations, feeds, drugs, dietary supplements) comprising the enzymes, polypeptides or polynucleotides of the invention. These compositions can be formulated in a variety of forms, e.g., as liquids, gels, pills, tablets, sprays, powders, food, feed pellets or encapsulated forms, including nanoencapsulated forms.

Assays for measuring cellulase activity, e.g., endoglucanase, cellobiohydrolase, beta-glucosidase, xylanase, mannanse, β-xylosidase, arabinofuranosidase, and/or oligomerase activity, e.g., for determining if a polypeptide has cellulase activity, e.g., endoglucanase, cellobiohydrolase, beta-glucosidase, xylanase, mannanse, β-xylosidase, arabinofuranosidase, and/or oligomerase activity, are well known in the art and are within the scope of the invention; see, e.g., Baker W L, Panow A, Estimation of cellulase activity using a glucose-oxidase-Cu(II) reducing assay for glucose, J Biochem Biophys Methods. 1991 December, 23(4):265-73; Sharrock K R, Cellulase assay methods: a review, J Biochem Biophys Methods. 1988 October, 17(2):81-105; Carder J H, Detection and quantitation of cellulase by Congo red staining of substrates in a cup-plate diffusion assay, Anal Biochem. 1986 Feb. 15, 153(1):75-9; Canevascini G., A cellulase assay coupled to cellobiose dehydrogenase, Anal Biochem. 1985 June, 147(2):419-27; Huang J S, Tang J, Sensitive assay for cellulase and dextrinase. Anal Biochem. 1976 June, 73(2): 369-77.

The pH of reaction conditions utilized by the invention is another variable parameter for which the invention provides. In certain aspects, the pH of the reaction is conducted in the range of about 3.0 to about 9.0. In other aspects, the pH is about 4.5 or the pH is about 7.5 or the pH is about 9. Reaction conditions conducted under alkaline conditions also can be advantageous, e.g., in some industrial or pharmaceutical applications of enzymes of the invention.

The invention provides cellulase, e.g., endoglucanase, cellobiohydrolase, beta-glucosidase, xylanase, mannanse, β-xylosidase, arabinofuranosidase, and/or oligomerase polypeptides of the invention in a variety of forms and formulations. In the methods of the invention, cellulase, e.g., endoglucanase, cellobiohydrolase, beta-glucosidase, xylanase, mannanse, β-xylosidase, arabinofuranosidase, and/or oligomerase polypeptides of the invention are used in a variety of forms and formulations. For example, purified cellulase, e.g., endoglucanase, cellobiohydrolase, beta-glucosidase, xylanase, mannanse, β-xylosidase, arabinofuranosidase, and/or oligomerase polypeptides can be used in enzyme preparations deployed in bioethanol production or in pharmaceutical or dietary aid applications. Alternatively, the enzymes of the invention can be used directly in processes to produce bioethanol, make clean fuels, process biowastes, process foods, liquids or feeds, and the like.

Alternatively, the cellulase, e.g., endoglucanase, cellobiohydrolase, beta-glucosidase, xylanase, mannanse, β-xylosidase, arabinofuranosidase, and/or oligomerase polypeptides of the invention can be expressed in a microorganism using procedures known in the art. In other aspects, the cellulase, e.g., endoglucanase, cellobiohydrolase, beta-glucosidase, xylanase, mannanse, β-xylosidase, arabinofuranosidase, and/or oligomerase polypeptides of the invention can be immobilized on a solid support prior to use in the methods of the invention. Methods for immobilizing enzymes on solid supports are commonly known in the art, for example J. Mol. Cat. B: Enzymatic 6 (1999) 29-39; Chivata et al. Biocatalysis: Immobilized cells and enzymes, J. Mol. Cat. 37 (1986) 1-24: Sharma et al., Immobilized Biomaterials Techniques and Applications, Angew. Chem. Int. Ed. Engl. 21 (1982) 837-54: Laskin (Ed.), Enzymes and Immobilized Cells in Biotechnology.

Nucleic Acids, Probes and Inhibitory Molecules

The invention provides isolated and recombinant nucleic acids, e.g., see Tables 1, 2, and 3, Examples 1 and 4, below, and Sequence Listing; nucleic acids encoding polypeptides, including the exemplary polynucleotide sequences of the invention, e.g., see Table 1 and Sequence Listing; including expression cassettes such as expression vectors and various cloning vehicles comprising nucleic acids of the invention. The invention also includes methods for discovering, identifying or isolated new cellulases, e.g., endoglucanase, cellobiohydrolase, beta-glucosidase, xylanase, mannanse, β-xylosidase, arabinofuranosidase, and/or oligomerase polypeptide sequences using the nucleic acids of the invention. The invention also includes methods for inhibiting the expression of cellulase, e.g., endoglucanase, cellobiohydrolase, beta-glucosidase, xylanase, mannanse, β-xylosidase, arabinofuranosidase, and/or oligomerase encoding genes and transcripts using the nucleic acids of the invention.

Also provided are methods for modifying the nucleic acids of the invention, including making variants of nucleic acids of the invention, by, e.g., synthetic ligation reassembly, optimized directed evolution system and/or saturation mutagenesis such as gene site saturation mutagenesis (GSSM). The term "saturation mutagenesis", Gene Site Saturation Mutagenesis, or "GSSM" includes a method that uses degenerate oligonucleotide primers to introduce point mutations into a polynucleotide, as described in detail, below. The term "optimized directed evolution system" or "optimized directed evolution" includes a method for reassembling fragments of related nucleic acid sequences, e.g., related genes, and explained in detail, below. The term "synthetic ligation reassembly" or "SLR" includes a method of ligating oligonucleotide fragments in a non-stochastic fashion, and explained in detail, below. The term "variant" refers to polynucleotides or polypeptides of the invention modified at one or more base pairs, codons, introns, exons, or amino acid residues (respectively) yet still retain the biological activity of a cellulase, e.g., endoglucanase, cellobiohydrolase, beta-glucosidase, xylanase, mannanse, β-xylosidase, arabinofuranosidase, and/or oligomerase of the invention. Variants can be produced by any number of means included methods such as, for example, error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, GSSM and any combination thereof.

The nucleic acids of the invention can be made, isolated and/or manipulated by, e.g., cloning and expression of cDNA libraries, amplification of message or genomic DNA by PCR, and the like. For example, exemplary sequences of the invention were initially derived from environmental sources. Thus, in one aspect, the invention provides cellulase, e.g., endoglucanase, cellobiohydrolase, beta-glucosidase, xylanase, mannanse, β-xylosidase, arabinofuranosidase, and/or oligomerase enzyme-encoding nucleic acids, and the polypeptides encoded by them, having a common novelty in that they are derived from a common source, e.g., an environmental, mixed culture, or a bacterial source.

In practicing the methods of the invention, homologous genes can be modified by manipulating a template nucleic acid, as described herein. The invention can be practiced in conjunction with any method or protocol or device known in the art, which are well described in the scientific and patent literature.

The phrases "nucleic acid" or "nucleic acid sequence" as used herein refer to an oligonucleotide, nucleotide, polynucleotide, or to a fragment of any of these, to DNA or RNA of genomic or synthetic origin which may be single-stranded or double-stranded and may represent a sense or antisense (complementary) strand, to peptide nucleic acid (PNA), or to any DNA-like or RNA-like material, natural or synthetic in origin. The phrases "nucleic acid" or "nucleic acid sequence" includes oligonucleotide, nucleotide, polynucleotide, or to a fragment of any of these, to DNA or RNA (e.g., mRNA, rRNA, tRNA, iRNA) of genomic or synthetic origin which may be single-stranded or double-stranded and may represent a sense or antisense strand, to peptide nucleic acid (PNA), or to any DNA-like or RNA-like material, natural or synthetic in origin, including, e.g., iRNA, ribonucleoproteins (e.g., e.g., double stranded iRNAs, e.g., iRNPs). The term encompasses nucleic acids, i.e., oligonucleotides, containing known analogues of natural nucleotides. The term also encompasses nucleic-acid-like structures with synthetic backbones, see e.g., Mata (1997) Toxicol. Appl. Pharmacol. 144:189-197; Strauss-Soukup (1997) Biochemistry 36:8692-8698; Samstag (1996) Antisense Nucleic Acid Drug Dev 6:153-156. "Oligonucleotide" includes either a single stranded polydeoxynucleotide or two complementary polydeoxynucleotide strands which may be chemically synthesized. Such synthetic oligonucleotides have no 5' phosphate and thus will not ligate to another oligonucleotide without adding a phosphate with an ATP in the presence of a kinase. A synthetic oligonucleotide can ligate to a fragment that has not been dephosphorylated.

A "coding sequence of" or a "nucleotide sequence encoding" a particular polypeptide or protein, is a nucleic acid sequence which is transcribed and translated into a polypeptide or protein when placed under the control of appropriate regulatory sequences. The term "gene" means the segment of DNA involved in producing a polypeptide chain; it includes regions preceding and following the coding region (leader and trailer) as well as, where applicable, intervening sequences (introns) between individual coding segments (exons). A promoter sequence is "operably linked to" a coding sequence when RNA polymerase which initiates transcription at the promoter will transcribe the coding sequence into mRNA. "Operably linked" as used herein refers to a functional relationship between two or more nucleic acid (e.g., DNA) segments. It can refer to the functional relationship of transcriptional regulatory sequence to a transcribed sequence. For example, a promoter is operably linked to a coding sequence, such as a nucleic acid of the invention, if it stimulates or modulates the transcription of the coding sequence in an appropriate host cell or other expression system. Generally, promoter transcriptional regulatory sequences that are operably linked to a transcribed sequence are physically contiguous to the transcribed sequence, i.e., they are cis-acting. However, some transcriptional regulatory sequences, such as enhancers, need not be physically contiguous or located in close proximity to the coding sequences whose transcription they enhance.

The term "expression cassette" as used herein refers to a nucleotide sequence which is capable of affecting expression of a structural gene (i.e., a protein coding sequence, such as a cellulase, e.g., endoglucanase, cellobiohydrolase, beta-glucosidase, xylanase, mannanse, β-xylosidase, arabinofuranosidase, and/or oligomerase enzyme of the invention) in a host compatible with such sequences. Expression cassettes include at least a promoter operably linked with the polypeptide coding sequence; and, optionally, with other sequences, e.g., transcription termination signals. Additional factors necessary or helpful in effecting expression may also be used, e.g., enhancers, alpha-factors. Thus, expression cassettes also include plasmids, expression vectors, recombinant viruses, any form of recombinant "naked DNA" vector, and the like. A "vector" comprises a nucleic acid which can infect, transfect, transiently or permanently transduce a cell. It will be recognized that a vector can be a naked nucleic acid, or a nucleic acid complexed with protein or lipid. The vector optionally comprises viral or bacterial nucleic acids and/or proteins, and/or membranes (e.g., a cell membrane, a viral lipid envelope, etc.). Vectors include, but are not limited to replicons (e.g., RNA replicons, bacteriophages) to which fragments of DNA may be attached and become replicated. Vectors thus include, but are not limited to RNA, autonomous self-replicating circular or linear DNA or RNA (e.g., plasmids, viruses, and the like, see, e.g., U.S. Pat. No. 5,217,879), and include both the expression and non-expression plasmids. Where a recombinant microorganism or cell culture is described as hosting an "expression vector" this includes both extra-chromosomal circular and linear DNA and DNA that has been incorporated into the host chromosome(s). Where a vector is being maintained by a host cell, the vector may either be stably replicated by the cells during mitosis as an autonomous structure, or is incorporated within the host's genome.

As used herein, the term "recombinant" encompasses nucleic acids adjacent to a "backbone" nucleic acid to which it is not adjacent in its natural environment. In one aspect, to be "enriched" the nucleic acids will represent about 5% or more of the number of nucleic acid inserts in a population of nucleic acid backbone molecules. Backbone molecules according to the invention include nucleic acids such as expression vectors, self-replicating nucleic acids, viruses, integrating nucleic acids and other vectors or nucleic acids used to maintain or manipulate a nucleic acid insert of interest. In one aspect, the enriched nucleic acids represent about 15% or more of the number of nucleic acid inserts in the population of recombinant backbone molecules. In one aspect, the enriched nucleic acids represent about 50% or more of the number of nucleic acid inserts in the population of recombinant backbone molecules. In a one aspect, the enriched nucleic acids represent about 90% or more of the number of nucleic acid inserts in the population of recombinant backbone molecules.

One aspect of the invention is an isolated, synthetic or recombinant nucleic acid comprising one of the sequences of the invention, or a fragment comprising at least 10, 15, 20, 25, 30, 35, 40, 50, 75, 100, 150, 200, 300, 400, or 500 or more consecutive bases of a nucleic acid of the invention. The isolated, synthetic or recombinant nucleic acids may comprise DNA, including cDNA, genomic DNA and synthetic DNA. The DNA may be double-stranded or single-stranded and if single stranded may be the coding strand or non-coding (anti-sense) strand. Alternatively, the isolated, synthetic or recombinant nucleic acids comprise RNA.

The isolated, synthetic or recombinant nucleic acids of the invention may be used to prepare one of the polypeptides of the invention, or fragments comprising at least 5, 10, 15, 20, 25, 30, 35, 40, 50, 75, 100, or 150 or more consecutive amino acids of one of the polypeptides of the invention. Accordingly, another aspect of the invention is an isolated, synthetic or recombinant nucleic acid which encodes one of the polypeptides of the invention, or fragments comprising at least 5, 10, 15, 20, 25, 30, 35, 40, 50, 75, 100, or 150 or more consecutive amino acids of one of the polypeptides of the invention. The coding sequences of these nucleic acids may be identical to one of the coding sequences of one of the nucleic acids of the invention or may be different coding sequences which encode one of the of the invention having at least 5, 10, 15, 20, 25, 30, 35, 40, 50, 75, 100, or 150 or more consecutive amino acids of one of the polypeptides of the invention, as a result of the redundancy or degeneracy of the genetic code. The genetic code is well known to those of skill in the art and can be obtained, e.g., on page 214 of B. Lewin, Genes VI, Oxford University Press, 1997.

The nucleic acids encoding polypeptides of the invention include but are not limited to: the coding sequence of a nucleic acid of the invention and additional coding sequences, such as leader sequences or proprotein sequences and non-coding sequences, such as introns or non-coding sequences 5' and/or 3' of the coding sequence. Thus, as used herein, the term "polynucleotide encoding a polypeptide" encompasses a polynucleotide which includes the coding sequence for the polypeptide as well as a polynucleotide which includes additional coding and/or non-coding sequence.

In one aspect, the nucleic acid sequences of the invention are mutagenized using conventional techniques, such as site directed mutagenesis, or other techniques familiar to those skilled in the art, to introduce silent changes into the polynucleotides o of the invention. As used herein, "silent changes" include, for example, changes which do not alter the amino acid sequence encoded by the polynucleotide. Such changes may be desirable in order to increase the level of the polypeptide produced by host cells containing a vector encoding the polypeptide by introducing codons or codon pairs which occur frequently in the host organism.

The invention also relates to polynucleotides which have nucleotide changes which result in amino acid substitutions, additions, deletions, fusions and truncations in the polypeptides of the invention. Such nucleotide changes may be introduced using techniques such as site directed mutagenesis, random chemical mutagenesis, exonuclease III deletion and other recombinant DNA techniques. Alternatively, such nucleotide changes may be naturally occurring allelic variants which are isolated by identifying nucleic acids which specifically hybridize to probes comprising at least 10, 15, 20, 25, 30, 35, 40, 50, 75, 100, 150, 200, 300, 400, or 500 consecutive bases of one of the sequences of the invention (or the sequences complementary thereto) under conditions of high, moderate, or low stringency as provided herein.

General Techniques

The nucleic acids used to practice this invention, whether RNA, siRNA, miRNA, antisense nucleic acid, cDNA, genomic DNA, vectors, viruses or hybrids thereof, may be isolated from a variety of sources, genetically engineered, amplified, and/or expressed/generated recombinantly. Recombinant polypeptides (e.g., cellulase, e.g., endoglucanase, cellobiohydrolase, beta-glucosidase, xylanase, mannanse, β-xylosidase, arabinofuranosidase, and/or oligomerase enzymes) generated from these nucleic acids can be individually isolated or cloned and tested for a desired activity. Any recombinant expression system can be used, including bacterial, mammalian, yeast, insect or plant cell expression systems.

Alternatively, these nucleic acids can be synthesized in vitro by well-known chemical synthesis techniques, as described in, e.g., Adams (1983) J. Am. Chem. Soc. 105:661; Belousov (1997) Nucleic Acids Res. 25:3440-3444; Frenkel (1995) Free Radic. Biol. Med. 19:373-380; Blommers (1994) Biochemistry 33:7886-7896; Narang (1979) Meth. Enzymol. 68:90; Brown (1979) Meth. Enzymol. 68:109; Beaucage (1981) Tetra. Lett. 22:1859; U.S. Pat. No. 4,458,066.

Techniques for the manipulation of nucleic acids, such as, e.g., subcloning, labeling probes (e.g., random-primer labeling using Klenow polymerase, nick translation, amplification), sequencing, hybridization and the like are well described in the scientific and patent literature, see, e.g., Sambrook, ed., MOLECULAR CLONING: A LABORATORY MANUAL (2ND ED.), Vols. 1-3, Cold Spring Harbor Laboratory, (1989); CURRENT PROTOCOLS IN MOLECULAR BIOLOGY, Ausubel, ed. John Wiley & Sons, Inc., New York (1997); LABORATORY TECHNIQUES IN BIOCHEMISTRY AND MOLECULAR BIOLOGY: HYBRIDIZATION WITH NUCLEIC ACID PROBES, Part I. Theory and Nucleic Acid Preparation, Tijssen, ed. Elsevier, N.Y. (1993).

Another useful means of obtaining and manipulating nucleic acids used to practice the methods of the invention is to clone from genomic samples, and, if desired, screen and re-clone inserts isolated or amplified from, e.g., genomic clones or cDNA clones. Sources of nucleic acid used in the methods of the invention include genomic or cDNA libraries contained in, e.g., mammalian artificial chromosomes (MACs), see, e.g., U.S. Pat. Nos. 5,721,118; 6,025,155; human artificial chromosomes, see, e.g., Rosenfeld (1997) Nat. Genet. 15:333-335; yeast artificial chromosomes (YAC); bacterial artificial chromosomes (BAC); P1 artificial chromosomes, see, e.g., Woon (1998) Genomics 50:306-316; P1-derived vectors (PACs), see, e.g., Kern (1997) Biotechniques 23:120-124; cosmids, recombinant viruses, phages or plasmids.

In one aspect, a nucleic acid encoding a polypeptide of the invention is assembled in appropriate phase with a leader sequence capable of directing secretion of the translated polypeptide or fragment thereof.

The invention provides fusion proteins and nucleic acids encoding them. A polypeptide of the invention can be fused to a heterologous peptide or polypeptide, such as N-terminal identification peptides which impart desired characteristics, such as increased stability or simplified purification. Peptides and polypeptides of the invention can also be synthesized and expressed as fusion proteins with one or more additional domains linked thereto for, e.g., producing a more immunogenic peptide, to more readily isolate a recombinantly synthesized peptide, to identify and isolate antibodies and antibody-expressing B cells, and the like. Detection and purification facilitating domains include, e.g., metal chelating peptides such as polyhistidine tracts and histidine-tryptophan modules that allow purification on immobilized metals, protein A domains that allow purification on immobilized immunoglobulin, and the domain utilized in the FLAGS extension/affinity purification system (Immunex Corp, Seattle Wash.). The inclusion of a cleavable linker sequences such as Factor Xa or enterokinase (Invitrogen, San Diego Calif.) between a purification domain and the motif-comprising peptide or polypeptide to facilitate purification. For example, an expression vector can include an epitope-encoding nucleic acid sequence linked to six histidine residues followed by a thioredoxin and an enterokinase cleavage site (see e.g., Williams (1995) Biochemistry 34:1787-1797; Dobeli (1998) Protein Expr. Purif. 12:404-414). The histidine residues facilitate detection and purification while the enterokinase cleavage site provides a means for purifying the epitope from the remainder of the fusion protein. Technology pertaining to vectors encoding fusion proteins and application of fusion proteins are well described in the scientific and patent literature, see e.g., Kroll (1993) DNA Cell. Biol., 12:441-53.

Transcriptional and Translational Control Sequences

The invention provides nucleic acid (e.g., DNA) sequences of the invention operatively linked to expression (e.g., transcriptional or translational) control sequence(s), e.g., promoters or enhancers, to direct or modulate RNA synthesis/expression. The expression control sequence can be in an expression vector. Exemplary bacterial promoters include lacI, lacZ, T3, T7, gpt, lambda PR, PL and trp. Exemplary eukaryotic promoters include CMV immediate early, HSV thymidine kinase, early and late SV40, LTRs from retrovirus, and mouse metallothionein I.

As used herein, the term "promoter" includes all sequences capable of driving transcription of a coding sequence in a cell, e.g., a plant or animal cell. Thus, promoters used in the constructs of the invention include cis-acting transcriptional control elements and regulatory sequences that are involved in regulating or modulating the timing and/or rate of transcription of a gene. For example, a promoter can be a cis-acting transcriptional control element, including an enhancer, a promoter, a transcription terminator, an origin of replication, a chromosomal integration sequence, 5' and 3' untranslated regions, or an intronic sequence, which are involved in transcriptional regulation. These cis-acting sequences can interact with proteins or other biomolecules to carry out (turn on/off, regulate, modulate, etc.) transcription. "Constitutive" promoters are those that drive expression continuously under most environmental conditions and states of development or cell differentiation. "Inducible" or "regulatable" promoters direct expression of the nucleic acid of the invention under the influence of environmental conditions or developmental conditions. Examples of environmental conditions that may affect transcription by inducible promoters include anaerobic conditions, elevated temperature, drought, or the presence of light.

"Tissue-specific" promoters are transcriptional control elements that are only active in particular cells or tissues or organs, e.g., in plants or animals. Tissue-specific regulation may be achieved by certain intrinsic factors which ensure that genes encoding proteins specific to a given tissue are expressed. Such factors are known to exist in mammals and plants so as to allow for specific tissues to develop.

Promoters suitable for expressing a polypeptide in bacteria include the E. coli lac or trp promoters, the lacI promoter, the lacZ promoter, the T3 promoter, the T7 promoter, the gpt promoter, the lambda PR promoter, the lambda PL promoter, promoters from operons encoding glycolytic enzymes such as 3-phosphoglycerate kinase (PGK), and the acid phosphatase promoter. Eukaryotic promoters include the CMV immediate early promoter, the HSV thymidine kinase promoter, heat shock promoters, the early and late SV40 promoter, LTRs from retroviruses, and the mouse metallothionein-I promoter. Other promoters known to control expression of genes in prokaryotic or eukaryotic cells or their viruses may also be used. Promoters suitable for expressing the polypeptide or fragment thereof in bacteria include the E. coli lac or trp promoters, the lacI promoter, the lacZ promoter, the T3 promoter, the T7 promoter, the gpt promoter, the lambda $P_R$ promoter, the lambda $P_L$ promoter, promoters from operons encoding glycolytic enzymes such as 3-phosphoglycerate kinase (PGK) and the acid phosphatase promoter. Fungal promoters include the α-factor promoter. Eukaryotic promoters include the CMV immediate early promoter, the HSV thymidine kinase promoter, heat shock promoters, the early and late SV40 promoter, LTRs from retroviruses and the mouse metallothionein-I promoter. Other promoters known to control expression of genes in prokaryotic or eukaryotic cells or their viruses may also be used.

Tissue-Specific Plant Promoters

The invention provides expression cassettes that can be expressed in a tissue-specific manner, e.g., that can express a cellulase, e.g., endoglucanase, cellobiohydrolase, beta-glucosidase, xylanase, mannanse, β-xylosidase, arabinofuranosidase, and/or oligomerase enzyme of the invention in a tissue-specific manner. The invention also provides plants or seeds that express a cellulase, e.g., endoglucanase, cellobiohydrolase, beta-glucosidase, xylanase, mannanse, β-xylosidase, arabinofuranosidase, and/or oligomerase enzyme of the invention in a tissue-specific manner. The tissue-specificity can be seed specific, stem specific, leaf specific, root specific, fruit specific and the like.

The term "plant" includes whole plants, plant parts (e.g., leaves, stems, flowers, roots, etc.), plant protoplasts, seeds and plant cells and progeny of same. The class of plants which can be used in the method of the invention is generally as broad as the class of higher plants amenable to transformation techniques, including angiosperms (monocotyledonous and dicotyledonous plants), as well as gymnosperms. It includes plants of a variety of ploidy levels, including polyploid, diploid, haploid and hemizygous states. As used herein, the term "transgenic plant" includes plants or plant cells into which a heterologous nucleic acid sequence has been inserted, e.g., the nucleic acids and various recombinant constructs (e.g., expression cassettes) of the invention.

In one aspect, a constitutive promoter such as the CaMV 35S promoter can be used for expression in specific parts of the plant or seed or throughout the plant. For example, for overexpression, a plant promoter fragment can be employed which will direct expression of a nucleic acid in some or all tissues of a plant, e.g., a regenerated plant. Such promoters are referred to herein as "constitutive" promoters and are active under most environmental conditions and states of development or cell differentiation. Examples of constitutive promoters include the cauliflower mosaic virus (CaMV) 35S transcription initiation region, the 1'- or 2'-promoter derived from T-DNA of *Agrobacterium tumefaciens*, and other transcription initiation regions from various plant genes known to those of skill. Such genes include, e.g., ACT11 from *Arabidopsis* (Huang (1996) Plant Mol. Biol. 33:125-139); Cat3 from *Arabidopsis* (GenBank No. U43147, Zhong (1996) Mol. Gen. Genet. 251:196-203); the gene encoding stearoyl-acyl carrier protein desaturase from *Brassica napus* (Genbank No. X74782, Solocombe (1994) Plant Physiol. 104: 1167-1176); GPc1 from maize (GenBank No. X15596; Martinez (1989) J. Mol. Biol. 209:551-565); the Gpc2 from maize (GenBank No. U45855, Manjunath (1997) *Plant Mol. Biol.* 33:97-112); plant promoters described in U.S. Pat. Nos. 4,962,028; 5,633,440.

The invention uses tissue-specific or constitutive promoters derived from viruses which can include, e.g., the tobamovirus subgenomic promoter (Kumagai (1995) Proc. Natl. Acad. Sci. USA 92:1679-1683; the rice tungro baciliform virus (RTBV), which replicates only in phloem cells in infected rice plants, with its promoter which drives strong phloem-specific reporter gene expression; the cassaya vein mosaic virus (CVMV) promoter, with highest activity in vascular elements, in leaf mesophyll cells, and in root tips (Verdaguer (1996) Plant Mol. Biol. 31:1129-1139).

In one aspect, the plant promoter directs expression of cellulase, e.g., endoglucanase, cellobiohydrolase, beta-glucosidase, xylanase, mannanse, β-xylosidase, arabinofuranosidase, and/or oligomerase enzyme-expressing nucleic acid in a specific tissue, organ or cell type (i.e. tissue-specific promoters) or may be otherwise under more precise environmental or developmental control or under the control of an inducible promoter. Examples of environmental conditions that may affect transcription include anaerobic conditions, elevated temperature, the presence of light, or sprayed with chemicals/hormones. For example, the invention incorporates the drought-inducible promoter of maize (Busk (1997) supra); the cold, drought, and high salt inducible promoter from potato (Kirch (1997) Plant Mol. Biol. 33:897 909).

In one aspect, tissue-specific promoters promote transcription only within a certain time frame of developmental stage within that tissue. See, e.g., Blazquez (1998) Plant Cell 10:791-800, characterizing the *Arabidopsis* LEAFY gene promoter. See also Cardon (1997) *Plant J* 12:367-77, describing the transcription factor SPL3, which recognizes a conserved sequence motif in the promoter region of the *A. thaliana* floral meristem identity gene AP1; and Mandel (1995) Plant Molecular Biology, Vol. 29, pp 995-1004, describing the meristem promoter eIF4. Tissue specific promoters which are active throughout the life cycle of a particular tissue can be used. In one aspect, the nucleic acids of the invention are operably linked to a promoter active primarily only in cotton fiber cells. In one aspect, the nucleic acids of the invention are operably linked to a promoter active primarily during the stages of cotton fiber cell elongation, e.g., as described by Rinehart (1996) supra. The nucleic acids can be operably linked to the Fb12A gene promoter to be preferentially expressed in cotton fiber cells (Ibid). See also, John (1997) Proc. Natl. Acad. Sci. USA 89:5769-5773; John, et al., U.S. Pat. Nos. 5,608,148 and 5,602,321, describing cotton fiber-specific promoters and methods for the construction of transgenic cotton plants. Root-specific promoters may also be used to express the nucleic acids of the invention. Examples of root-specific promoters include the promoter from the alcohol dehydrogenase gene (DeLisle (1990) Int. Rev. Cytol. 123:39-60). Other promoters that can be used to express the nucleic acids of the invention include, e.g., ovule-specific, embryo-specific, endosperm-specific, integument-specific, seed coat-specific promoters, or some combination thereof, a leaf-specific promoter (see, e.g., Busk (1997) Plant J. 11:1285 1295, describing a leaf-specific promoter in maize); the ORF13 promoter from *Agrobacterium rhizogenes* (which exhibits high activity in roots, see, e.g., Hansen (1997) supra); a maize pollen specific promoter (see, e.g., Guerrero (1990) Mol. Gen. Genet. 224:161 168); a tomato promoter active during fruit ripening, senescence and abscission of leaves and, to a lesser extent, of flowers can be used (see, e.g., Blume (1997) Plant J. 12:731 746); a pistil-specific promoter from the potato SK2 gene (see, e.g., Ficker (1997) Plant Mol. Biol. 35:425 431); the Blec4 gene from pea, which is active in epidermal tissue of vegetative and floral shoot apices of transgenic alfalfa making it a useful tool to target the expression of foreign genes to the epidermal layer of actively growing shoots or fibers; the ovule-specific BEL1 gene (see, e.g., Reiser (1995) Cell 83:735-742, GenBank No. U39944); and/or, the promoter in Klee, U.S. Pat. No. 5,589,583, describing a plant promoter region is capable of conferring high levels of transcription in meristematic tissue and/or rapidly dividing cells.

In one aspect, plant promoters which are inducible upon exposure to plant hormones, such as auxins, are used to express the nucleic acids of the invention. For example, the invention can use the auxin-response elements E1 promoter fragment (AuxREs) in the soybean (*Glycine max* L.) (Liu (1997) Plant Physiol. 115:397-407); the auxin-responsive *Arabidopsis* GST6 promoter (also responsive to salicylic acid and hydrogen peroxide) (Chen (1996) Plant J. 10: 955-966); the auxin-inducible parC promoter from tobacco (Sakai (1996) 37:906-913); a plant biotin response element (Streit (1997) Mol. Plant. Microbe Interact. 10:933-937); and, the promoter responsive to the stress hormone abscisic acid (Sheen (1996) Science 274:1900-1902).

The nucleic acids of the invention can also be operably linked to plant promoters which are inducible upon exposure to chemicals reagents which can be applied to the plant, such as herbicides or antibiotics. For example, the maize In2-2 promoter, activated by benzenesulfonamide herbicide safeners, can be used (De Veylder (1997) Plant Cell Physiol. 38:568-577); application of different herbicide safeners induces distinct gene expression patterns, including expression in the root, hydathodes, and the shoot apical meristem. Coding sequence can be under the control of, e.g., a tetracycline-inducible promoter, e.g., as described with transgenic tobacco plants containing the *Avena sativa* L. (oat) arginine decarboxylase gene (Masgrau (1997) Plant J. 11:465-473); or, a salicylic acid-responsive element (Stange (1997) Plant J. 11:1315-1324). Using chemically- (e.g., hormone- or pesticide-) induced promoters, i.e., promoter responsive to a chemical which can be applied to the transgenic plant in the field, expression of a polypeptide of the invention can be induced at a particular stage of development of the plant. Thus, the invention also provides for transgenic plants containing an inducible gene encoding for polypeptides of the invention whose host range is limited to target plant species, such as corn, rice, barley, soybean, tomato, wheat, potato or other crops, inducible at any stage of development of the crop.

One of skill will recognize that a tissue-specific plant promoter may drive expression of operably linked sequences in tissues other than the target tissue. Thus, in one aspect, a tissue-specific promoter is one that drives expression preferentially in the target tissue or cell type, but may also lead to some expression in other tissues as well.

The nucleic acids of the invention can also be operably linked to plant promoters which are inducible upon exposure to chemicals reagents. These reagents include, e.g., herbicides, synthetic auxins, or antibiotics which can be applied, e.g., sprayed, onto transgenic plants. Inducible expression of the cellulase, e.g., endoglucanase, cellobiohydrolase, beta-glucosidase, xylanase, mannanse, β-xylosidase, arabinofuranosidase, and/or oligomerase enzyme-producing nucleic acids of the invention will allow the grower to select plants with the optimal cellulase, e.g., endoglucanase, cellobiohydrolase, beta-glucosidase, xylanase, mannanse, β-xylosidase, arabinofuranosidase, and/or oligomerase enzyme expression and/or activity. The development of plant parts can thus controlled. In this way the invention provides the means to facilitate the harvesting of plants and plant parts. For example, in various embodiments, the maize In2-2 promoter, activated by benzenesulfonamide herbicide safeners, is used (De Veylder (1997) Plant Cell Physiol. 38:568-577); application of different herbicide safeners induces distinct gene expression patterns, including expression in the root, hydathodes, and the shoot apical meristem. Coding sequences of the invention are also under the control of a tetracycline-inducible promoter, e.g., as described with transgenic tobacco plants containing the *Avena sativa* L. (oat) arginine decarboxylase gene (Masgrau (1997) Plant J. 11:465-473); or, a salicylic acid-responsive element (Stange (1997) Plant J. 11:1315-1324).

In some aspects, proper polypeptide expression may require polyadenylation region at the 3'-end of the coding region. The polyadenylation region can be derived from the natural gene, from a variety of other plant (or animal or other) genes, or from genes in the Agrobacterial T-DNA.

Expression Vectors and Cloning Vehicles

The invention provides expression vectors and cloning vehicles comprising nucleic acids of the invention, e.g., sequences encoding the cellulase, e.g., endoglucanase, cellobiohydrolase, beta-glucosidase, xylanase, mannanse, β-xylosidase, arabinofuranosidase, and/or oligomerase enzymes of the invention. Expression vectors and cloning vehicles of the invention can comprise viral particles, baculovirus, phage, plasmids, phagemids, cosmids, fosmids, bacterial artificial chromosomes, viral DNA (e.g., vaccinia, adenovirus, foul pox virus, pseudorabies and derivatives of SV40), P1-based artificial chromosomes, yeast plasmids, yeast artificial chromosomes, and any other vectors specific for specific hosts of interest (such as *bacillus, Aspergillus* and yeast). Vectors of the invention can include chromosomal, non-chromosomal and synthetic DNA sequences. Large numbers of suitable vectors are known to those of skill in the art, and are commercially available. Exemplary vectors are include: bacterial: pQE™ vectors (Qiagen), pBLUESCRIPT™ plasmids, pNH vectors, (lambda-ZAP vectors (Stratagene); ptrc99a, pKK223-3, pDR540, pRIT2T (Pharmacia); Eukaryotic: pXT1, pSG5 (Stratagene), pSVK3, pBPV, pMSG, pSV-LSV40 (Pharmacia). However, any other plasmid or other vector may be used so long as they are replicable and viable in the host. Low copy number or high copy number vectors may be employed with the present invention. "Plasmids" can be commercially available, publicly available on an unrestricted basis, or can be constructed from available plasmids in accord with published procedures. Equivalent plasmids to those described herein are known in the art and will be apparent to the ordinarily skilled artisan.

The expression vector can comprise a promoter, a ribosome binding site for translation initiation and a transcription terminator. The vector may also include appropriate sequences for amplifying expression. Mammalian expression vectors can comprise an origin of replication, any necessary ribosome binding sites, a polyadenylation site, splice donor and acceptor sites, transcriptional termination sequences, and 5' flanking non-transcribed sequences. In some aspects, DNA sequences derived from the SV40 splice and polyadenylation sites may be used to provide the required non-transcribed genetic elements.

In one aspect, the expression vectors contain one or more selectable marker genes to permit selection of host cells containing the vector. Such selectable markers include genes encoding dihydrofolate reductase or genes conferring neomycin resistance for eukaryotic cell culture, genes conferring tetracycline or ampicillin resistance in *E. coli*, and the *S. cerevisiae* TRP1 gene. Promoter regions can be selected from any desired gene using chloramphenicol transferase (CAT) vectors or other vectors with selectable markers.

In one aspect, vectors for expressing the polypeptide or fragment thereof in eukaryotic cells contain enhancers to increase expression levels. Enhancers are cis-acting elements of DNA that can be from about 10 to about 300 bp in length. They can act on a promoter to increase its transcription. Exemplary enhancers include the SV40 enhancer on the late side of the replication origin bp 100 to 270, the cytoinegalovirus early promoter enhancer, the polyoma enhancer on the late side of the replication origin, and the adenovirus enhancers.

A nucleic acid sequence can be inserted into a vector by a variety of procedures. In general, the sequence is ligated to the desired position in the vector following digestion of the insert and the vector with appropriate restriction endonucleases. Alternatively, blunt ends in both the insert and the vector may be ligated. A variety of cloning techniques are known in the art, e.g., as described in Ausubel and Sambrook. Such procedures and others are deemed to be within the scope of those skilled in the art.

The vector can be in the form of a plasmid, a viral particle, or a phage. Other vectors include chromosomal, non-chromosomal and synthetic DNA sequences, derivatives of SV40; bacterial plasmids, phage DNA, baculovirus, yeast plasmids, vectors derived from combinations of plasmids and phage DNA, viral DNA such as vaccinia, adenovirus, fowl pox virus, and pseudorabies. A variety of cloning and expression vectors for use with prokaryotic and eukaryotic hosts are described by, e.g., Sambrook.

Particular bacterial vectors which can be used include the commercially available plasmids comprising genetic elements of the well known cloning vector pBR322 (ATCC 37017), pKK223-3 (Pharmacia Fine Chemicals, Uppsala, Sweden), GEM1 (Promega Biotec, Madison, Wis., USA) pQE70, pQE60, pQE-9 (Qiagen), pD10, psiX174 pBLUESCRIPT II KS, pNH8A, pNH16a, pNH18A, pNH46A (Stratagene), ptrc99a, pKK223-3, pKK233-3, DR540, pRIT5 (Pharmacia), pKK232-8 and pCM7. Particular eukaryotic vectors include pSV2CAT, pOG44, pXT1, pSG (Stratagene) pSVK3, pBPV, pMSG, and pSVL (Pharmacia). However, any other vector may be used as long as it is replicable and viable in the host cell.

The nucleic acids of the invention can be expressed in expression cassettes, vectors or viruses and transiently or stably expressed in plant cells and seeds. One exemplary transient expression system uses episomal expression systems, e.g., cauliflower mosaic virus (CaMV) viral RNA generated in the nucleus by transcription of an episomal mini-chromosome containing supercoiled DNA, see, e.g., Covey (1990) Proc. Natl. Acad. Sci. USA 87:1633-1637. Alternatively, coding sequences, i.e., all or sub-fragments of sequences of the invention can be inserted into a plant host cell genome becoming an integral part of the host chromosomal DNA. Sense or antisense transcripts can be expressed in this manner. A vector comprising the sequences (e.g., promoters or coding regions) from nucleic acids of the invention can comprise a marker gene that confers a selectable phenotype on a plant cell or a seed. For example, the marker may encode biocide resistance, e.g., antibiotic resistance, such as resistance to kanamycin, G418, bleomycin, hygromycin, or herbicide resistance, such as resistance to chlorosulfuron or Basta.

Expression vectors capable of expressing nucleic acids and proteins in plants are well known in the art, and can include, e.g., vectors from *Agrobacterium* spp., potato virus X (see, e.g., Angell (1997) EMBO J. 16:3675-3684), tobacco mosaic virus (see, e.g., Casper (1996) Gene 173:69-73), tomato bushy stunt virus (see, e.g., Hillman (1989) Virology 169:42-50), tobacco etch virus (see, e.g., Dolja (1997) Virology 234:243-252), bean golden mosaic virus (see, e.g., Morinaga (1993) Microbiol Immunol. 37:471-476), cauliflower mosaic virus (see, e.g., Cecchini (1997) Mol. Plant. Microbe Interact. 10:1094-1101), maize Ac/Ds transposable element (see, e.g., Rubin (1997) Mol. Cell. Biol. 17:6294-6302; Kunze (1996) Curr. Top. Microbiol. Immunol. 204:161-194), and the maize suppressor-mutator (Spm) transposable element (see, e.g., Schlappi (1996) Plant Mol. Biol. 32:717-725); and derivatives thereof.

In one aspect, the expression vector can have two replication systems to allow it to be maintained in two organisms, for example in mammalian or insect cells for expression and in a prokaryotic host for cloning and amplification. Furthermore, for integrating expression vectors, the expression vector can contain at least one sequence homologous to the host cell genome. It can contain two homologous sequences which flank the expression construct. The integrating vector can be directed to a specific locus in the host cell by selecting the appropriate homologous sequence for inclusion in the vector. Constructs for integrating vectors are well known in the art.

Expression vectors of the invention may also include a selectable marker gene to allow for the selection of bacterial strains that have been transformed, e.g., genes which render the bacteria resistant to drugs such as ampicillin, chloramphenicol, erythromycin, kanamycin, neomycin and tetracycline. Selectable markers can also include biosynthetic genes, such as those in the histidine, tryptophan and leucine biosynthetic pathways.

The DNA sequence in the expression vector is operatively linked to an appropriate expression control sequence(s) (promoter) to direct RNA synthesis. Particular named bacterial promoters include lacI, lacZ, T3, T7, gpt, lambda $P_R$, $P_L$ and trp. Eukaryotic promoters include CMV immediate early, HSV thymidine kinase, early and late SV40, LTRs from retrovirus and mouse metallothionein-I. Selection of the appropriate vector and promoter is well within the level of ordinary skill in the art. The expression vector also contains a ribosome binding site for translation initiation and a transcription terminator. The vector may also include appropriate sequences for amplifying expression. Promoter regions can be selected from any desired gene using chloramphenicol transferase (CAT) vectors or other vectors with selectable markers. In addition, the expression vectors in one aspect contain one or more selectable marker genes to provide a phenotypic trait for selection of transformed host cells such as dihydrofolate reductase or neomycin resistance for eukaryotic cell culture, or such as tetracycline or ampicillin resistance in *E. coli*.

Mammalian expression vectors may also comprise an origin of replication, any necessary ribosome binding sites, a polyadenylation site, splice donor and acceptor sites, transcriptional termination sequences and 5' flanking nontranscribed sequences. In some aspects, DNA sequences derived from the SV40 splice and polyadenylation sites may be used to provide the required nontranscribed genetic elements.

Vectors for expressing the polypeptide or fragment thereof in eukaryotic cells may also contain enhancers to increase expression levels. Enhancers are cis-acting elements of DNA, usually from about 10 to about 300 bp in length that act on a promoter to increase its transcription. Examples include the SV40 enhancer on the late side of the replication origin bp 100 to 270, the cytomegalovirus early promoter enhancer, the polyoma enhancer on the late side of the replication origin and the adenovirus enhancers.

In addition, the expression vectors can contain one or more selectable marker genes to permit selection of host cells containing the vector. Such selectable markers include genes encoding dihydrofolate reductase or genes conferring neomycin resistance for eukaryotic cell culture, genes conferring tetracycline or ampicillin resistance in *E. coli* and the *S. cerevisiae* TRP1 gene.

In some aspects, the nucleic acid encoding one of the polypeptides of the invention, or fragments comprising at least about 5, 10, 15, 20, 25, 30, 35, 40, 50, 75, 100, or 150 or more consecutive amino acids thereof is assembled in appropriate phase with a leader sequence capable of directing secretion of the translated polypeptide or fragment thereof. In one aspect, the nucleic acid can encode a fusion polypeptide in which one of the polypeptides of the invention, or fragments comprising at least 5, 10, 15, 20, 25, 30, 35, 40, 50, 75, 100, or 150 or more consecutive amino acids thereof is fused to heterologous peptides or polypeptides, such as N-terminal identification peptides which impart desired characteristics, such as increased stability or simplified purification.

The appropriate DNA sequence may be inserted into the vector by a variety of procedures. In general, the DNA sequence is ligated to the desired position in the vector following digestion of the insert and the vector with appropriate restriction endonucleases. Alternatively, blunt ends in both the insert and the vector may be ligated. A variety of cloning techniques are disclosed in Ausubel et al. Current Protocols in Molecular Biology, John Wiley 503 Sons, Inc. 1997 and Sambrook et al., Molecular Cloning: A Laboratory Manual 2nd Ed., Cold Spring Harbor Laboratory Press (1989. Such procedures and others are deemed to be within the scope of those skilled in the art.

The vector may be, for example, in the form of a plasmid, a viral particle, or a phage. Other vectors include chromosomal, nonchromosomal and synthetic DNA sequences, derivatives of SV40; bacterial plasmids, phage DNA, baculovirus, yeast plasmids, vectors derived from combinations of plasmids and phage DNA, viral DNA such as vaccinia, adenovirus, fowl pox virus and pseudorabies. A variety of cloning and expression vectors for use with prokaryotic and eukaryotic hosts are described by Sambrook, et al., Molecular Cloning: A Laboratory Manual, 2nd Ed., Cold Spring Harbor, N.Y., (1989).

Host Cells and Transformed Cells

The invention also provides a transformed cell comprising a nucleic acid sequence of the invention, e.g., a sequence encoding a cellulase, e.g., endoglucanase, cellobiohydrolase, beta-glucosidase, xylanase, mannanse, β-xylosidase, arabinofuranosidase, and/or oligomerase enzyme of the invention, or a vector of the invention. The host cell may be any of the host cells familiar to those skilled in the art, including prokaryotic cells, eukaryotic cells, such as bacterial cells, fungal cells, yeast cells, mammalian cells, insect cells, or plant cells. Exemplary bacterial cells include any species of *Streptomyces, Pseudomonas, Staphylococcus* or *Bacillus*, or the exemplary species *E. coli, Bacillus subtilis, Bacillus cereus, Salmonella typhimurium*. Exemplary insect cells include any species of *Spodoptera* or *Drosophila*, including *Drosophila* S2 and *Spodoptera* Sf9. Exemplary animal cells include CHO, COS or Bowes melanoma or any mouse or human cell line. The selection of an appropriate host is within the abilities of those skilled in the art. Techniques for transforming a wide variety of higher plant species are well known and described in the technical and scientific literature. See, e.g., Weising (1988) Ann. Rev. Genet. 22:421-477; U.S. Pat. No. 5,750,870.

The vector can be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis, L., Dibner, M., Battey, I., Basic Methods in Molecular Biology, (1986)).

In one aspect, the nucleic acids or vectors of the invention are introduced into the cells for screening, thus, the nucleic acids enter the cells in a manner suitable for subsequent expression of the nucleic acid. The method of introduction is largely dictated by the targeted cell type. Exemplary methods include $CaPO_4$ precipitation, liposome fusion, lipofection (e.g., LIPOFECTIN™), electroporation, viral infection, etc. The candidate nucleic acids may stably integrate into the genome of the host cell (for example, with retroviral introduction) or may exist either transiently or stably in the cytoplasm (i.e. through the use of traditional plasmids, utilizing standard regulatory sequences, selection markers, etc.). As many pharmaceutically important screens require human or model mammalian cell targets, retroviral vectors capable of transfecting such targets can be used.

Where appropriate, the engineered host cells can be cultured in conventional nutrient media modified as appropriate for activating promoters, selecting transformants or amplifying the genes of the invention. Following transformation of a suitable host strain and growth of the host strain to an appropriate cell density, the selected promoter may be induced by appropriate means (e.g., temperature shift or chemical induction) and the cells may be cultured for an additional period to allow them to produce the desired polypeptide or fragment thereof.

Cells can be harvested by centrifugation, disrupted by physical or chemical means, and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

The constructs in host cells can be used in a conventional manner to produce the gene product encoded by the recombinant sequence. Depending upon the host employed in a recombinant production procedure, the polypeptides produced by host cells containing the vector may be glycosylated or may be non-glycosylated. Polypeptides of the invention may or may not also include an initial methionine amino acid residue.

Cell-free translation systems can also be employed to produce a polypeptide of the invention. Cell-free translation systems can use mRNAs transcribed from a DNA construct comprising a promoter operably linked to a nucleic acid encoding the polypeptide or fragment thereof. In some aspects, the DNA construct may be linearized prior to conducting an in vitro transcription reaction. The transcribed mRNA is then incubated with an appropriate cell-free translation extract, such as a rabbit reticulocyte extract, to produce the desired polypeptide or fragment thereof.

The expression vectors can contain one or more selectable marker genes to provide a phenotypic trait for selection of transformed host cells such as dihydrofolate reductase or neomycin resistance for eukaryotic cell culture, or such as tetracycline or ampicillin resistance in *E. coli*.

Host cells containing the polynucleotides of interest, e.g., nucleic acids of the invention, can be cultured in conventional nutrient media modified as appropriate for activating promoters, selecting transformants or amplifying genes. The culture conditions, such as temperature, pH and the like, are those previously used with the host cell selected for expression and will be apparent to the ordinarily skilled artisan. The clones which are identified as having the specified enzyme activity may then be sequenced to identify the polynucleotide sequence encoding an enzyme having the enhanced activity.

The invention provides a method for overexpressing a recombinant cellulase, e.g., endoglucanase, cellobiohydrolase, beta-glucosidase, xylanase, mannanse, β-xylosidase, arabinofuranosidase, and/or oligomerase enzyme in a cell comprising expressing a vector comprising a nucleic acid of the invention, e.g., a nucleic acid comprising a nucleic acid sequence with at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to an exemplary sequence of the invention over a region of at least about 100 residues, wherein the sequence identities are determined by analysis with a sequence comparison algorithm or by visual inspection, or, a nucleic acid that hybridizes under stringent conditions to a nucleic acid sequence of the invention. The overexpression can be effected by any means, e.g., use of a high activity promoter, a dicistronic vector or by gene amplification of the vector.

The nucleic acids of the invention can be expressed, or overexpressed, in any in vitro or in vivo expression system. Any cell culture systems can be employed to express, or over-express, recombinant protein, including bacterial, insect, yeast, fungal or mammalian cultures. Over-expression can be effected by appropriate choice of promoters, enhancers, vectors (e.g., use of replicon vectors, dicistronic vectors (see, e.g., Gurtu (1996) Biochem. Biophys. Res. Commun. 229:295-8), media, culture systems and the like. In one aspect, gene amplification using selection markers, e.g., glutamine synthetase (see, e.g., Sanders (1987) Dev. Biol. Stand. 66:55-63), in cell systems are used to overexpress the polypeptides of the invention. The host cell may be any of the host cells familiar to those skilled in the art, including prokaryotic cells, eukaryotic cells, mammalian cells, insect cells, or plant cells. The selection of an appropriate host is within the abilities of those skilled in the art.

The vector may be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis, L., Dibner, M., Battey, I., Basic Methods in Molecular Biology, (1986)).

Where appropriate, the engineered host cells can be cultured in conventional nutrient media modified as appropriate for activating promoters, selecting transformants or amplifying the genes of the invention. Following transformation of a suitable host strain and growth of the host strain to an appropriate cell density, the selected promoter may be induced by appropriate means (e.g., temperature shift or chemical induction) and the cells may be cultured for an additional period to allow them to produce the desired polypeptide or fragment thereof.

Cells can be harvested by centrifugation, disrupted by physical or chemical means and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

Various mammalian cell culture systems can also be employed to express recombinant protein. Examples of mammalian expression systems include the COS-7 lines of monkey kidney fibroblasts (described by Gluzman, Cell, 23:175, 1981) and other cell lines capable of expressing proteins from a compatible vector, such as the C127, 3T3, CHO, HeLa and BHK cell lines.

The constructs in host cells can be used in a conventional manner to produce the gene product encoded by the recombinant sequence. Depending upon the host employed in a recombinant production procedure, the polypeptides produced by host cells containing the vector may be glycosylated or may be non-glycosylated. Polypeptides of the invention may or may not also include an initial methionine amino acid residue.

Alternatively, the polypeptides of the invention, or fragments comprising at least 5, 10, 15, 20, 25, 30, 35, 40, 50, 75, 100, or 150 or more consecutive amino acids thereof can be synthetically produced by conventional peptide synthesizers, e.g., as discussed below. In other aspects, fragments or portions of the polypeptides may be employed for producing the corresponding full-length polypeptide by peptide synthesis; therefore, the fragments may be employed as intermediates for producing the full-length polypeptides.

Cell-free translation systems can also be employed to produce one of the polypeptides of the invention, or fragments comprising at least 5, 10, 15, 20, 25, 30, 35, 40, 50, 75, 100, or 150 or more consecutive amino acids thereof using mRNAs transcribed from a DNA construct comprising a promoter operably linked to a nucleic acid encoding the polypeptide or fragment thereof. In some aspects, the DNA construct may be linearized prior to conducting an in vitro transcription reaction. The transcribed mRNA is then incubated with an appropriate cell-free translation extract, such as a rabbit reticulocyte extract, to produce the desired polypeptide or fragment thereof.

Amplification of Nucleic Acids

In practicing the invention, nucleic acids of the invention and nucleic acids encoding the cellulase, e.g., endoglucanase, cellobiohydrolase, beta-glucosidase, xylanase, mannanse, β-xylosidase, arabinofuranosidase, and/or oligomerase enzymes of the invention, or modified nucleic acids of the invention, can be reproduced by amplification, e.g., PCR. Amplification can also be used to clone or modify the nucleic acids of the invention. Thus, the invention provides amplification primer sequence pairs for amplifying nucleic acids of the invention. One of skill in the art can design amplification primer sequence pairs for any part of or the full length of these sequences.

In one aspect, the invention provides a nucleic acid amplified by an amplification primer pair of the invention, e.g., a primer pair as set forth by about the first (the 5') 12, 13, 14, 15, 16, 17, 18, 19, 20, 21, 22, 23, 24, or 25 or more residues of a nucleic acid of the invention, and about the first (the 5') 15, 16, 17, 18, 19, 20, 21, 22, 23, 24, or 25 or more residues of the complementary strand. The invention provides amplification primer sequence pairs for amplifying a nucleic acid encoding a polypeptide having a cellulase, e.g., endoglucanase, cellobiohydrolase, beta-glucosidase, xylanase, mannanse, β-xylosidase, arabinofuranosidase, and/or oligomerase enzyme activity, wherein the primer pair is capable of amplifying a nucleic acid comprising a sequence of the invention, or fragments or subsequences thereof. One or each member of the amplification primer sequence pair can comprise an oligonucleotide comprising at least about 10 to 50 or more consecutive bases of the sequence, or about 12, 13, 14, 15, 16, 17, 18, 19, 20, 21, 22, 23, 24, or 25 or more consecutive bases of the sequence. The invention provides amplification primer pairs, wherein the primer pair comprises a first member having a sequence as set forth by about the first (the 5') 12, 13, 14, 15, 16, 17, 18, 19, 20, 21, 22, 23, 24, or 25 or more residues of a nucleic acid of the invention, and a second member having a sequence as set forth by about the first (the 5') 12, 13, 14, 15, 16, 17, 18, 19, 20, 21, 22, 23, 24, or 25 or more residues of the complementary strand of the first member.

The invention provides cellulase, e.g., endoglucanase, cellobiohydrolase, beta-glucosidase, xylanase, mannanse, β-xylosidase, arabinofuranosidase, and/or oligomerase enzymes generated by amplification, e.g., polymerase chain reaction (PCR), using an amplification primer pair of the invention. The invention provides methods of making a cellulase, e.g., endoglucanase, cellobiohydrolase, beta-glucosidase, xylanase, mannanse, β-xylosidase, arabinofuranosidase, and/or oligomerase enzyme by amplification, e.g., PCR, using an amplification primer pair of the invention. In one aspect, the amplification primer pair amplifies a nucleic acid from a library, e.g., a gene library, such as an environmental library.

Amplification reactions can also be used to quantify the amount of nucleic acid in a sample (such as the amount of message in a cell sample), label the nucleic acid (e.g., to apply it to an array or a blot), detect the nucleic acid, or quantify the amount of a specific nucleic acid in a sample. In one aspect of the invention, message isolated from a cell or a cDNA library are amplified.

The skilled artisan can select and design suitable oligonucleotide amplification primers. Amplification methods are also well known in the art, and include, e.g., polymerase chain reaction, PCR (see, e.g., PCR PROTOCOLS, A GUIDE TO METHODS AND APPLICATIONS, ed. Innis, Academic Press, N.Y. (1990) and PCR STRATEGIES (1995), ed. Innis, Academic Press, Inc., N.Y., ligase chain reaction (LCR) (see, e.g., Wu (1989) Genomics 4:560; Landegren (1988) Science 241:1077; Barringer (1990) Gene 89:117); transcription amplification (see, e.g., Kwoh (1989) Proc. Natl. Acad. Sci. USA 86:1173); and, self-sustained sequence replication (see, e.g., Guatelli (1990) Proc. Natl. Acad. Sci. USA 87:1874); Q Beta replicase amplification (see, e.g., Smith (1997) J. Clin. Microbiol. 35:1477-1491), automated Q-beta replicase amplification assay (see, e.g., Burg (1996) Mol. Cell. Probes 10:257-271) and other RNA polymerase mediated techniques (e.g., NASBA, Cangene, Mississauga, Ontario); see also Berger (1987) Methods Enzymol. 152:307-316; Sambrook; Ausubel; U.S. Pat. Nos. 4,683,195 and 4,683,202; Sooknanan (1995) Biotechnology 13:563-564.

Determining Sequence Identity in Nucleic Acids and Polypeptides

The invention provides nucleic acids comprising sequences having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity (homology) to an exemplary nucleic acid of the invention (see also Tables 1, 2, and 3, Examples 1 and 4, below, and Sequence Listing) over a region of at least about 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550 or more, residues. The invention provides polypeptides comprising sequences having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary polypeptide of the invention (see Tables 1, 2, and 3, Examples 1 and 4, below, and Sequence Listing). The extent of sequence identity (homology) may be determined using any computer program and associated parameters, including those described herein, such as BLAST 2.2.2. or FASTA version 3.0t78, with the default parameters.

Nucleic acid sequences of the invention can comprise at least 10, 15, 20, 25, 30, 35, 40, 50, 75, 100, 150, 200, 300, 400, or 500 or more consecutive nucleotides of an exemplary sequence of the invention and sequences substantially identical thereto. Homologous sequences and fragments of nucleic acid sequences of the invention can refer to a sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more sequence identity (homology) to these sequences. Homology (sequence identity) may be determined using any of the computer programs and parameters described herein, including FASTA version 3.0t78 with the default parameters. Homologous sequences also include RNA sequences in which uridines replace the thymines in the nucleic acid sequences of the invention. The homologous sequences may be obtained using any of the procedures described herein or may result from the correction of a sequencing error. It will be appreciated that the nucleic acid sequences of the invention can be represented in the traditional single character format (See the inside back cover of Stryer, Lubert. Biochemistry, 3rd Ed., W. H Freeman & Co., New York.) or in any other format which records the identity of the nucleotides in a sequence.

In various aspects, sequence comparison programs identified herein are used in this aspect of the invention, i.e., to determine if a nucleic acid or polypeptide sequence is within the scope of the invention. However, protein and/or nucleic acid sequence identities (homologies) may be evaluated using any sequence comparison algorithm or program known in the art. Such algorithms and programs include, but are by no means limited to, TBLASTN, BLASTP, FASTA, TFASTA and CLUSTALW (see, e.g., Pearson and Lipman, Proc. Natl. Acad. Sci. USA 85(8):2444-2448, 1988; Altschul et al., J. Mol. Biol. 215(3):403-410, 1990; Thompson Nucleic Acids Res. 22(2):4673-4680, 1994; Higgins et al., Methods Enzymol. 266:383-402, 1996; Altschul et al., J. Mol. Biol. 215(3): 403-410, 1990; Altschul et al., Nature Genetics 3:266-272, 1993).

In one aspect, homology or identity is measured using sequence analysis software (e.g., Sequence Analysis Software Package of the Genetics Computer Group, University of Wisconsin Biotechnology Center, 1710 University Avenue, Madison, Wis. 53705). Such software matches similar sequences by assigning degrees of homology to various deletions, substitutions and other modifications. In one aspect, the terms "homology" and "identity" in the context of two or more nucleic acids or polypeptide sequences, refer to two or more sequences or subsequences that are the same or have a specified percentage of amino acid residues or nucleotides that are the same when compared and aligned for maximum correspondence over a comparison window or designated region as measured using any number of sequence comparison algorithms or by manual alignment and visual inspection. In one aspect, for sequence comparison, one sequence acts as a reference sequence, to which test sequences are compared. When using a sequence comparison algorithm, test and reference sequences are entered into a computer, subsequence coordinates are designated, if necessary and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequence for comparison are well-known in the art. Optimal alignment of sequences for comparison can be conducted, e.g., by the local homology algorithm of Smith & Waterman, Adv. Appl. Math. 2:482, 1981, by the homology alignment algorithm of Needleman & Wunsch, J. Mol. Biol. 48:443, 1970, by the search for similarity method of person & Lipman, Proc. Nat'l. Acad. Sci. USA 85:2444, 1988, by computerized implementations of these algorithms (GAP, BESTFIT, FASTA and TFASTA in the Wisconsin Genetics Software Package, Genetics Computer Group, 575 Science Dr., Madison, Wis.), or by manual alignment and visual inspection. Other algorithms for determining homology or identity include, for example, in addition to a BLAST program (Basic Local Alignment Search Tool at the National Center for Biological Information), ALIGN, AMAS (Analysis of Multiply Aligned Sequences), AMPS (Protein Multiple Sequence Alignment), ASSET (Aligned Segment Statistical Evaluation Tool), BANDS, BESTSCOR, BIOSCAN (Biological Sequence Comparative Analysis Node), BLIMPS (BLocks IMProved Searcher), FASTA, Intervals & Points, BMB, CLUSTAL V, CLUSTAL W, CONSENSUS, LCONSENSUS, WCONSENSUS, Smith-Waterman algorithm, DARWIN, Las Vegas algorithm, FNAT (Forced Nucleotide Alignment Tool), Framealign, Framesearch, DYNAMIC, FILTER, FSAP (Fristensky Sequence Analysis Package), GAP (Global Alignment Program), GENAL, GIBBS, GenQuest, ISSC (Sensitive Sequence Comparison), LALIGN (Local Sequence Alignment), LCP (Local Content Program), MACAW (Multiple Alignment Construction & Analysis Workbench), MAP (Multiple Alignment Program), MBLKP, MBLKN, PIMA (Pattern-Induced Multi-sequence Alignment), SAGA (Sequence Alignment by Genetic Algorithm) and WHAT-IF. Such alignment programs can also be used to screen genome databases to identify polynucleotide sequences having substantially identical sequences. A number of genome databases are available, for example, a substantial portion of the human genome is available as part of the Human Genome Sequencing Project (Gibbs, 1995). At least twenty-one other genomes have already been sequenced, including, for example, M. genitalium (Fraser et al., 1995), M. jannaschii (Bult et al., 1996), H. influenzae (Fleischmann et al., 1995), E. coli (Blattner et al., 1997) and yeast (S. cerevisiae) (Mewes et al., 1997) and D. melanogaster (Adams et al., 2000). Significant progress has also been made in sequencing the genomes of model organism, such as mouse, C. elegans and Arabadopsis sp. Several databases containing genomic information annotated with some functional information are maintained by different organizations and may be accessible via the internet.

In one aspect, BLAST and BLAST 2.0 algorithms are used, which are described in Altschul et al., Nuc. Acids Res. 25:3389-3402, 1977 and Altschul et al., J. Mol. Biol. 215: 403-410, 1990, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a wordlength (W) of 11, an expectation (E) of 10, M=5, N=−4 and a comparison of both strands. For amino acid sequences, the BLASTP program uses as defaults a wordlength of 3 and expectations (E) of 10 and the BLOSUM62 scoring matrix (see Henikoff & Henikoff, Proc. Natl. Acad. Sci. USA 89:10915, 1989) alignments (B) of 50, expectation (E) of 10, M=5, N=−4 and a comparison of both strands.

The BLAST algorithm also performs a statistical analysis of the similarity between two sequences (see, e.g., Karlin & Altschul, Proc. Natl. Acad. Sci. USA 90:5873, 1993). One measure of similarity provided by BLAST algorithm is the smallest sum probability (P(N)), which provides an indication of the probability by which a match between two nucleotide or amino acid sequences would occur by chance. For example, a nucleic acid is considered similar to a references sequence if the smallest sum probability in a comparison of the test nucleic acid to the reference nucleic acid is less than about 0.2, more in one aspect less than about 0.01 and most in one aspect less than about 0.001.

In one aspect, protein and nucleic acid sequence homologies are evaluated using the Basic Local Alignment Search Tool ("BLAST") In particular, five specific BLAST programs are used to perform the following task:

(1) BLASTP and BLAST3 compare an amino acid query sequence against a protein sequence database;
(2) BLASTN compares a nucleotide query sequence against a nucleotide sequence database;
(3) BLASTX compares the six-frame conceptual translation products of a query nucleotide sequence (both strands) against a protein sequence database;
(4) TBLASTN compares a query protein sequence against a nucleotide sequence database translated in all six reading frames (both strands); and
(5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is in one aspect obtained from a protein or nucleic acid sequence database. High-scoring segment pairs are in one aspect identified (i.e., aligned) by means of a scoring matrix, many of which are known in the art. In one aspect, the scoring matrix used is the BLOSUM62 matrix (Gonnet (1992) Science 256:1443-1445; Henikoff and Henikoff (1993) Proteins 17:49-61). Less in one aspect, the PAM or PAM250 matrices may also be used (see, e.g., Schwartz and Dayhoff, eds., 1978, *Matrices for Detecting Distance Relationships: Atlas of Protein Sequence and Structure*, Washington: National Biomedical Research Foundation). BLAST programs are accessible through the U.S. National Library of Medicine.

The parameters used with the above algorithms may be adapted depending on the sequence length and degree of homology studied. In some aspects, the parameters may be the default parameters used by the algorithms in the absence of instructions from the user.

Computer Systems and Computer Program Products

The invention provides computers, computer systems, computer readable mediums, computer programs products and the like recorded or stored thereon the nucleic acid and polypeptide sequences of the invention. Additionally, in practicing the methods of the invention, e.g., to determine and identify sequence identities (to determine whether a nucleic acid is within the scope of the invention), structural homologies, motifs and the like in silico, a nucleic acid or polypeptide sequence of the invention can be stored, recorded, and manipulated on any medium which can be read and accessed by a computer.

As used herein, the words "recorded" and "stored" refer to a process for storing information on a computer medium. A skilled artisan can readily adopt any known methods for recording information on a computer readable medium to generate manufactures comprising one or more of the nucleic acid and/or polypeptide sequences of the invention. As used herein, the terms "computer," "computer program" and "processor" are used in their broadest general contexts and incorporate all such devices, as described in detail, below. A "coding sequence of" or a "sequence encodes" a particular polypeptide or protein, is a nucleic acid sequence which is transcribed and translated into a polypeptide or protein when placed under the control of appropriate regulatory sequences.

The polypeptides of the invention include exemplary sequences of the invention and sequences substantially identical thereto, and subsequences (fragments) of any of the preceding sequences. In one aspect, substantially identical, or homologous, polypeptide sequences refer to a polypeptide sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity (homology) to an exemplary sequence of the invention.

Homology (sequence identity) may be determined using any of the computer programs and parameters described herein. A nucleic acid or polypeptide sequence of the invention can be stored, recorded and manipulated on any medium which can be read and accessed by a computer. As used herein, the words "recorded" and "stored" refer to a process for storing information on a computer medium. A skilled artisan can readily adopt any of the presently known methods for recording information on a computer readable medium to generate manufactures comprising one or more of the nucleic acid sequences of the invention, one or more of the polypeptide sequences of the invention. Another aspect of the invention is a computer readable medium having recorded thereon at least 2, 5, 10, 15, or 20 or more nucleic acid or polypeptide sequences of the invention.

Another aspect of the invention is a computer readable medium having recorded thereon one or more of the nucleic acid sequences of the invention. Another aspect of the invention is a computer readable medium having recorded thereon one or more of the polypeptide sequences of the invention. Another aspect of the invention is a computer readable medium having recorded thereon at least 2, 5, 10, 15, or 20 or more of the nucleic acid or polypeptide sequences as set forth above.

Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other types of other media known to those skilled in the art.

Aspects of the invention include systems (e.g., internet based systems), e.g., computer systems which, store and manipulate the sequence information described herein. One example of a computer system 100 is illustrated in block diagram form in FIG. 1. As used herein, "a computer system" refers to the hardware components, software components and data storage components used to analyze a nucleotide sequence of a nucleic acid sequence of the invention, or a polypeptide sequence of the invention. In one aspect, the computer system 100 includes a processor for processing, accessing and manipulating the sequence data. The processor 105 can be any well-known type of central processing unit, such as, for example, the Pentium III from Intel Corporation, or similar processor from Sun, Motorola, Compaq, AMD or International Business Machines.

In one aspect, the computer system 100 is a general purpose system that comprises the processor 105 and one or more internal data storage components 110 for storing data and one or more data retrieving devices for retrieving the data stored on the data storage components. A skilled artisan can readily appreciate that any one of the currently available computer systems are suitable.

In one particular aspect, the computer system 100 includes a processor 105 connected to a bus which is connected to a main memory 115 (in one aspect implemented as RAM) and one or more internal data storage devices 110, such as a hard drive and/or other computer readable media having data recorded thereon. In some aspects, the computer system 100 further includes one or more data retrieving device 118 for reading the data stored on the internal data storage devices 110.

The data retrieving device 118 may represent, for example, a floppy disk drive, a compact disk drive, a magnetic tape drive, or a modem capable of connection to a remote data storage system (e.g., via the internet) etc. In some aspects, the internal data storage device 110 is a removable computer readable medium such as a floppy disk, a compact disk, a magnetic tape, etc. containing control logic and/or data recorded thereon. The computer system 100 may advantageously include or be programmed by appropriate software for reading the control logic and/or the data from the data storage component once inserted in the data retrieving device.

The computer system 100 includes a display 120 which is used to display output to a computer user. It should also be noted that the computer system 100 can be linked to other computer systems 125a-c in a network or wide area network to provide centralized access to the computer system 100.

Software for accessing and processing the nucleotide sequences of a nucleic acid sequence of the invention, or a polypeptide sequence of the invention, (such as search tools, compare tools and modeling tools etc.) may reside in main memory 115 during execution.

In some aspects, the computer system 100 may further comprise a sequence comparison algorithm for comparing a nucleic acid sequence of the invention, or a polypeptide sequence of the invention, stored on a computer readable medium to a reference nucleotide or polypeptide sequence(s) stored on a computer readable medium. A "sequence comparison algorithm" refers to one or more programs which are implemented (locally or remotely) on the computer system 100 to compare a nucleotide sequence with other nucleotide sequences and/or compounds stored within a data storage means. For example, the sequence comparison algorithm may compare the nucleotide sequences of a nucleic acid sequence of the invention, or a polypeptide sequence of the invention, stored on a computer readable medium to reference sequences stored on a computer readable medium to identify homologies or structural motifs.

Figure 2:
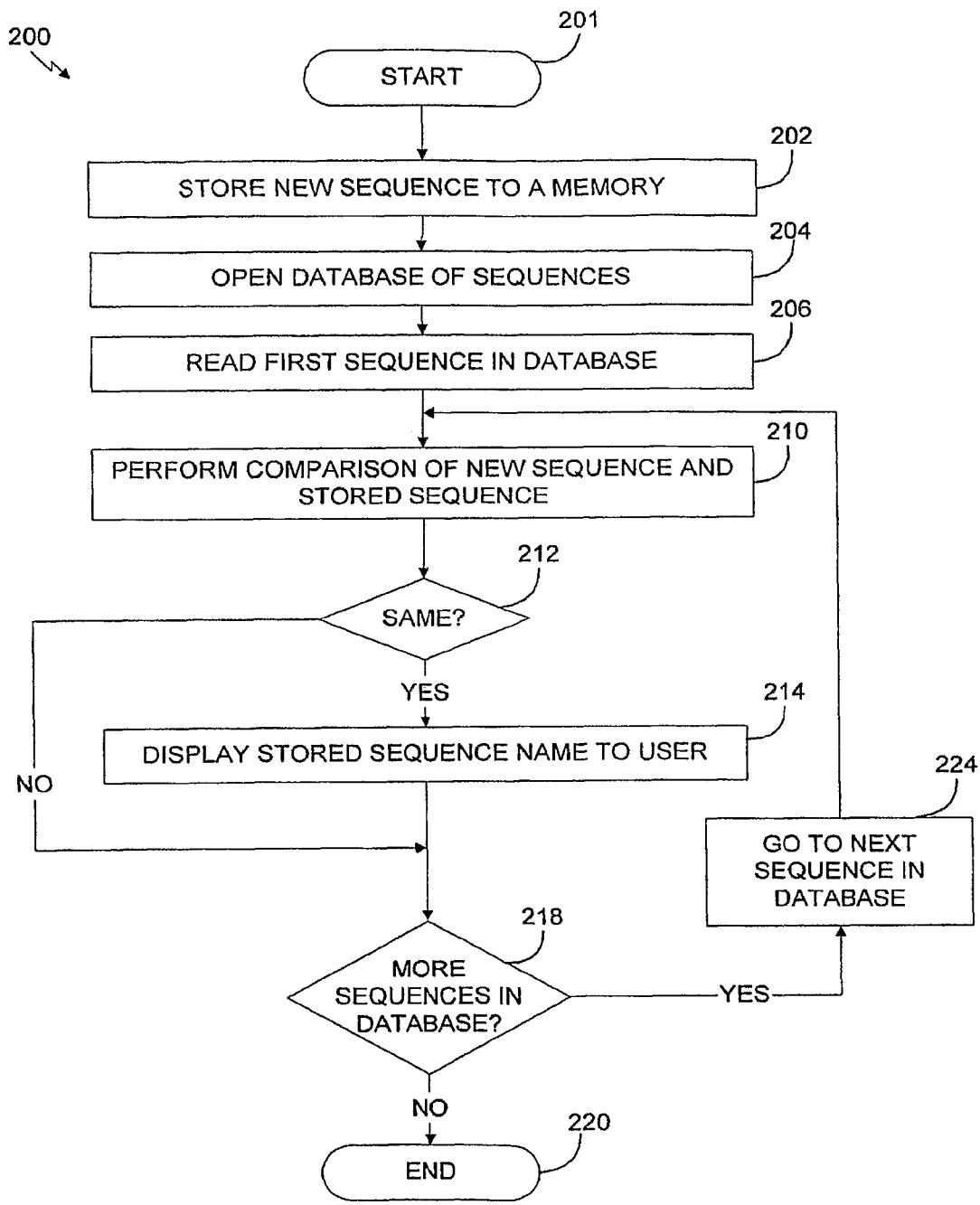
FIG. 2 is a flow diagram illustrating one aspect of a process for comparing a new nucleotide or protein sequence with a database of sequences in order to determine the homology levels between the new sequence and the sequences in the database.

FIG. 2 is a flow diagram illustrating one aspect of a process 200 for comparing a new nucleotide or protein sequence with a database of sequences in order to determine the homology levels between the new sequence and the sequences in the database. The database of sequences can be a private database stored within the computer system 100, or a public database such as GENBANK that is available through the Internet.

The process 200 begins at a start state 201 and then moves to a state 202 wherein the new sequence to be compared is stored to a memory in a computer system 100. As discussed above, the memory could be any type of memory, including RAM or an internal storage device.

The process 200 then moves to a state 204 wherein a database of sequences is opened for analysis and comparison. The process 200 then moves to a state 206 wherein the first sequence stored in the database is read into a memory on the computer. A comparison is then performed at a state 210 to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are introduced into a sequence during comparison are normally entered by the user of the computer system.

Once a comparison of the two sequences has been performed at the state 210, a determination is made at a decision state 210 whether the two sequences are the same. Of course, the term "same" is not limited to sequences that are absolutely identical. Sequences that are within the homology parameters entered by the user will be marked as "same" in the process 200.

If a determination is made that the two sequences are the same, the process 200 moves to a state 214 wherein the name of the sequence from the database is displayed to the user. This state notifies the user that the sequence with the displayed name fulfills the homology constraints that were entered. Once the name of the stored sequence is displayed to the user, the process 200 moves to a decision state 218 wherein a determination is made whether more sequences exist in the database. If no more sequences exist in the database, then the process 200 terminates at an end state 220. However, if more sequences do exist in the database, then the process 200 moves to a state 224 wherein a pointer is moved to the next sequence in the database so that it can be compared to the new sequence. In this manner, the new sequence is aligned and compared with every sequence in the database.

It should be noted that if a determination had been made at the decision state 212 that the sequences were not homologous, then the process 200 would move immediately to the decision state 218 in order to determine if any other sequences were available in the database for comparison.

Accordingly, one aspect of the invention is a computer system comprising a processor, a data storage device having stored thereon a nucleic acid sequence of the invention, or a polypeptide sequence of the invention, a data storage device having retrievably stored thereon reference nucleotide sequences or polypeptide sequences to be compared to a nucleic acid sequence of the invention, or a polypeptide sequence of the invention and a sequence comparer for conducting the comparison. The sequence comparer may indicate a homology level between the sequences compared or identify structural motifs in the above described nucleic acid code a nucleic acid sequence of the invention, or a polypeptide sequence of the invention, or it may identify structural motifs in sequences which are compared to these nucleic acid codes and polypeptide codes. In some aspects, the data storage device may have stored thereon the sequences of at least 2, 5, 10, 15, 20, 25, 30 or 40 or more of the nucleic acid sequences of the invention, or the polypeptide sequences of the invention.

Another aspect of the invention is a method for determining the level of homology between a nucleic acid sequence of the invention, or a polypeptide sequence of the invention and a reference nucleotide sequence. The method including reading the nucleic acid code or the polypeptide code and the reference nucleotide or polypeptide sequence through the use of a computer program which determines homology levels and determining homology between the nucleic acid code or polypeptide code and the reference nucleotide or polypeptide sequence with the computer program. The computer program may be any of a number of computer programs for determining homology levels, including those specifically enumerated herein, (e.g., BLAST2N with the default parameters or with any modified parameters). The method may be implemented using the computer systems described above. The method may also be performed by reading at least 2, 5, 10, 15, 20, 25, 30 or 40 or more of the above described nucleic acid sequences of the invention, or the polypeptide sequences of the invention through use of the computer program and determining homology between the nucleic acid codes or polypeptide codes and reference nucleotide sequences or polypeptide sequences.

Figure 3:
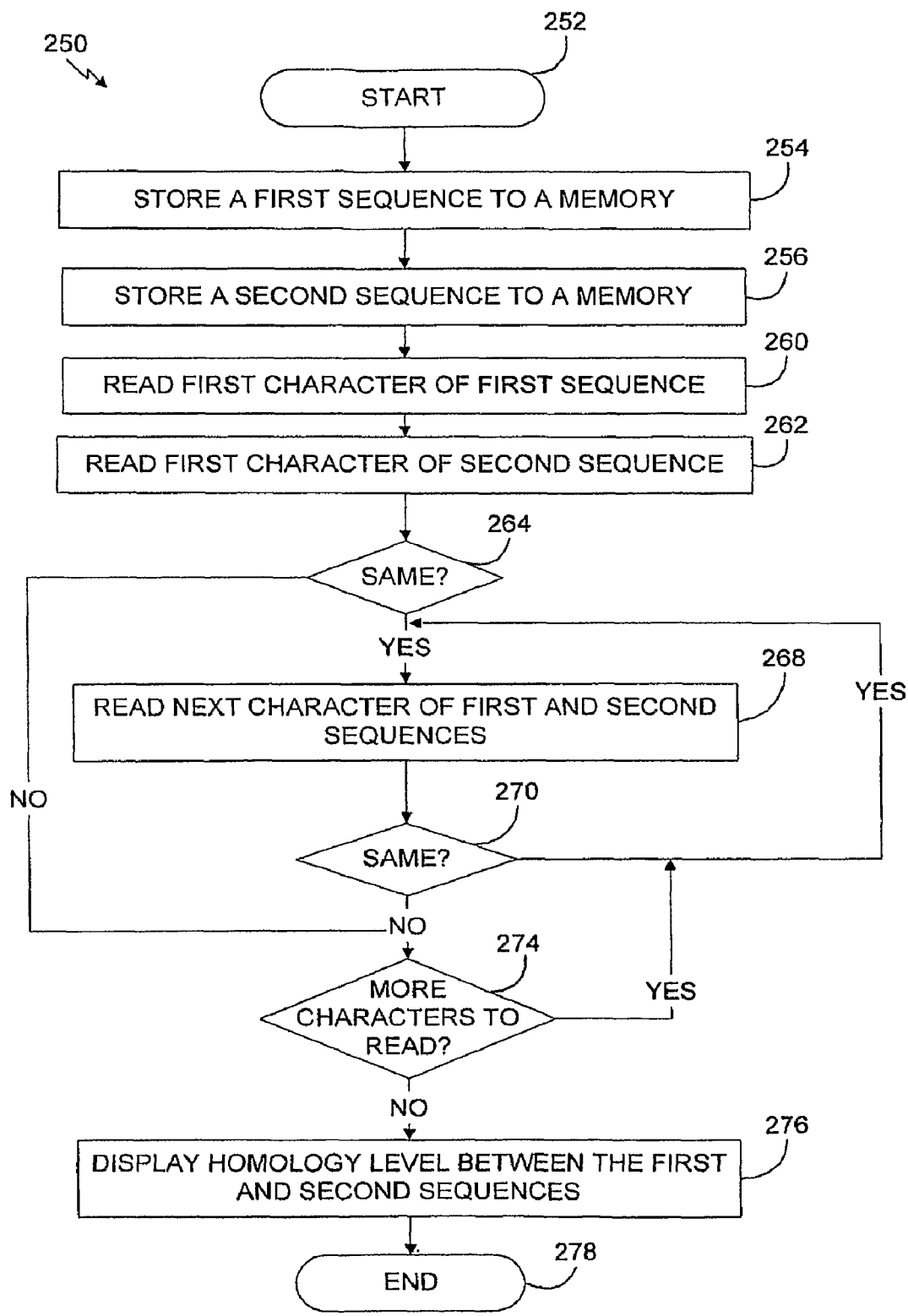
FIG. 3 is a flow diagram illustrating one aspect of a process in a computer for determining whether two sequences are homologous.

FIG. 3 is a flow diagram illustrating one aspect of a process 250 in a computer for determining whether two sequences are homologous. The process 250 begins at a start state 252 and then moves to a state 254 wherein a first sequence to be compared is stored to a memory. The second sequence to be compared is then stored to a memory at a state 256. The process 250 then moves to a state 260 wherein the first character in the first sequence is read and then to a state 262 wherein the first character of the second sequence is read. It should be understood that if the sequence is a nucleotide sequence, then the character would normally be either A, T, C, G or U. If the sequence is a protein sequence, then it is in one aspect in the single letter amino acid code so that the first and sequence sequences can be easily compared.

A determination is then made at a decision state 264 whether the two characters are the same. If they are the same, then the process 250 moves to a state 268 wherein the next characters in the first and second sequences are read. A determination is then made whether the next characters are the same. If they are, then the process 250 continues this loop until two characters are not the same. If a determination is made that the next two characters are not the same, the process 250 moves to a decision state 274 to determine whether there are any more characters either sequence to read.

If there are not any more characters to read, then the process 250 moves to a state 276 wherein the level of homology between the first and second sequences is displayed to the user. The level of homology is determined by calculating the proportion of characters between the sequences that were the same out of the total number of sequences in the first sequence. Thus, if every character in a first 100 nucleotide sequence aligned with a every character in a second sequence, the homology level would be 100%.

Alternatively, the computer program may be a computer program which compares the nucleotide sequences of a nucleic acid sequence as set forth in the invention, to one or more reference nucleotide sequences in order to determine whether the nucleic acid code of the invention, differs from a reference nucleic acid sequence at one or more positions. Optionally such a program records the length and identity of inserted, deleted or substituted nucleotides with respect to the sequence of either the reference polynucleotide or a nucleic acid sequence of the invention. In one aspect, the computer program may be a program which determines whether a nucleic acid sequence of the invention, contains a single nucleotide polymorphism (SNP) with respect to a reference nucleotide sequence.

Accordingly, another aspect of the invention is a method for determining whether a nucleic acid sequence of the invention, differs at one or more nucleotides from a reference nucleotide sequence comprising the steps of reading the nucleic acid code and the reference nucleotide sequence through use of a computer program which identifies differences between nucleic acid sequences and identifying differences between the nucleic acid code and the reference nucleotide sequence with the computer program. In some aspects, the computer program is a program which identifies single nucleotide polymorphisms. The method may be implemented by the computer systems described above and the method illustrated in FIG. 3. The method may also be performed by reading at least 2, 5, 10, 15, 20, 25, 30, or 40 or more of the nucleic acid sequences of the invention and the reference nucleotide sequences through the use of the computer program and identifying differences between the nucleic acid codes and the reference nucleotide sequences with the computer program.

In other aspects the computer based system may further comprise an identifier for identifying features within a nucleic acid sequence of the invention or a polypeptide sequence of the invention. An "identifier" refers to one or more programs which identifies certain features within a nucleic acid sequence of the invention, or a polypeptide sequence of the invention. In one aspect, the identifier may comprise a program which identifies an open reading frame in a nucleic acid sequence of the invention.

Figure 4:
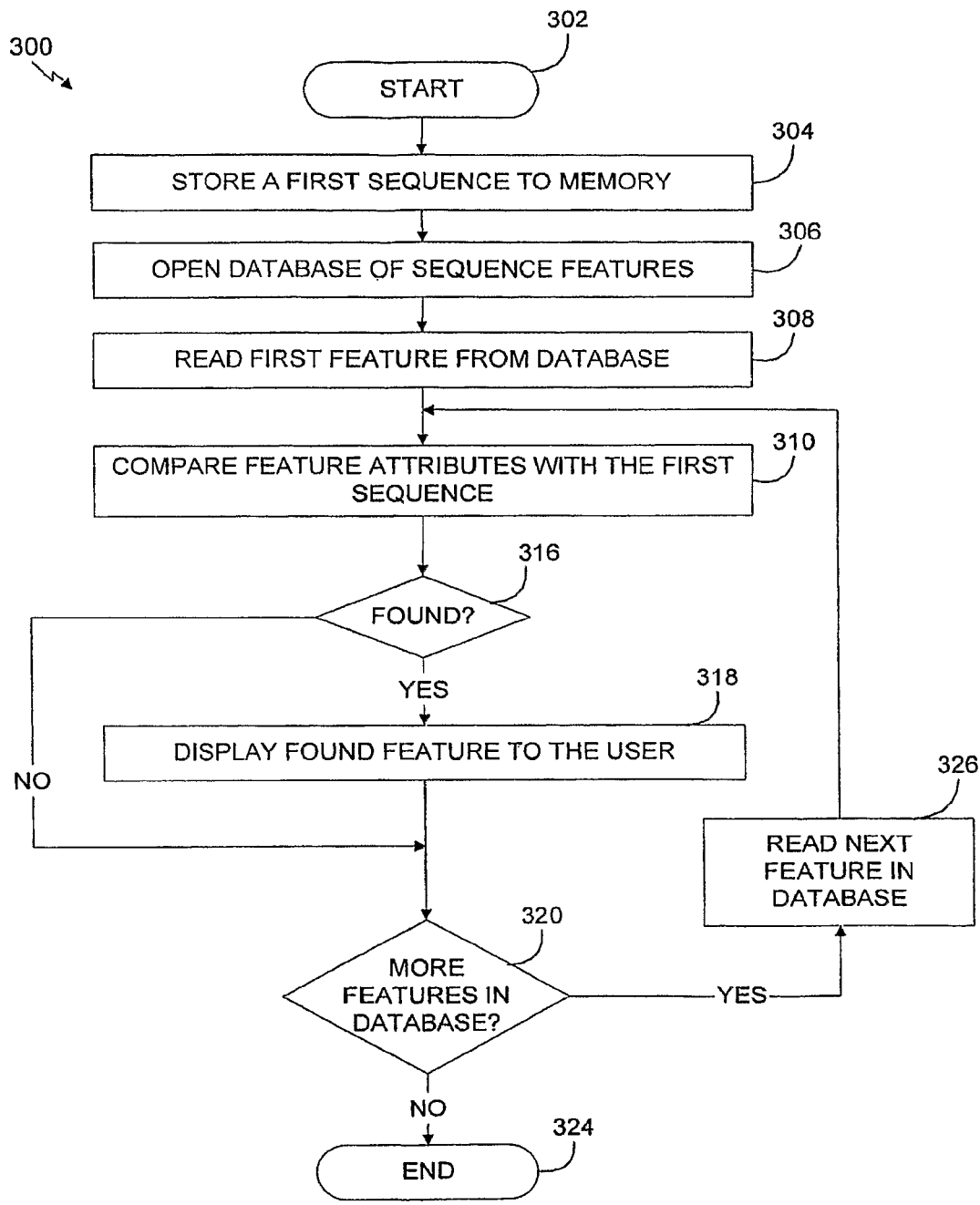
FIG. 4 is a flow diagram illustrating one aspect of an identifier process 300 for detecting the presence of a feature in a sequence.
Figure 5:
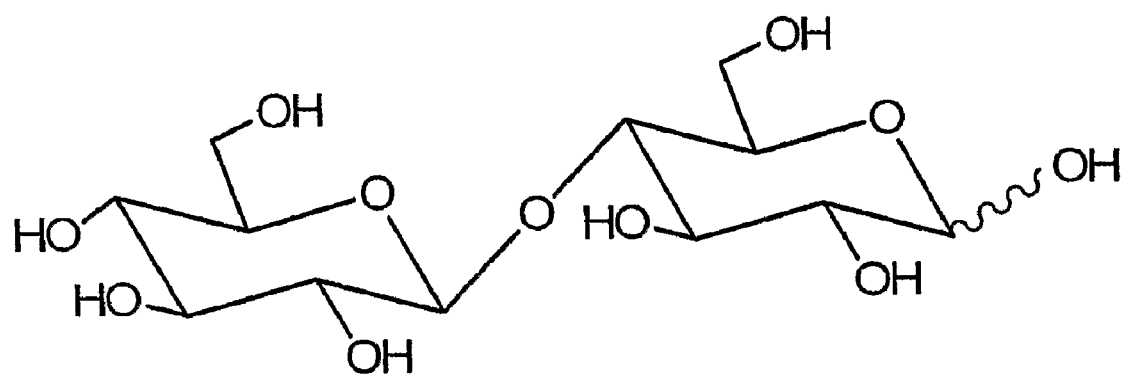
FIG. 5 is an illustration of the structure of cellobiose.
Figure 6:
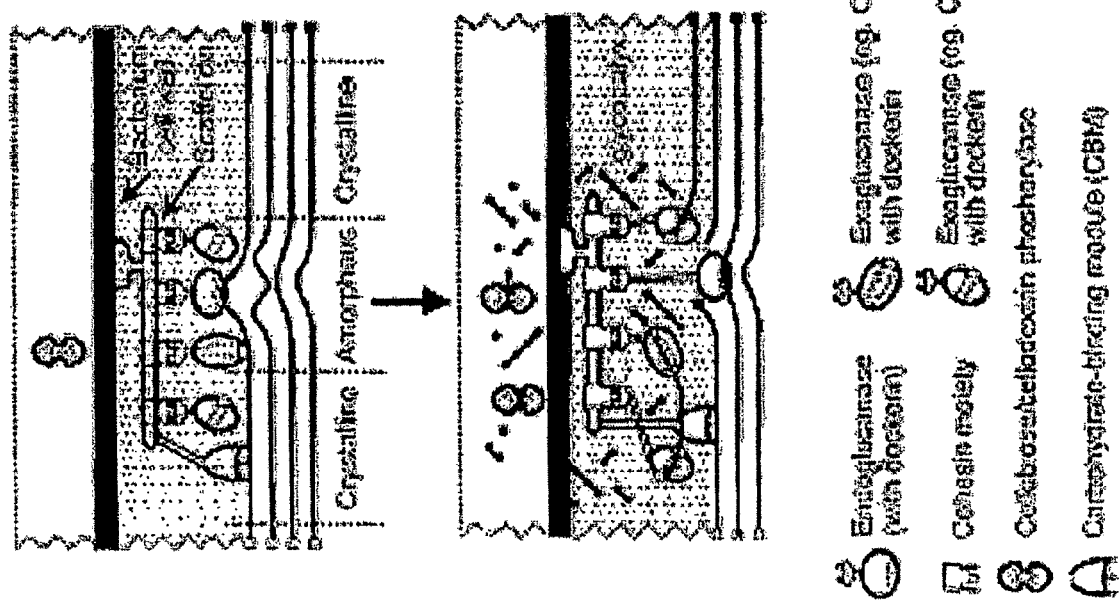
FIGS. 6, 7 and 8 are schematic illustrations of the enzymatically driven pathway for digesting cellulose (FIGS. 6 and 7) and hemicellulose (FIG. 8); as discussed in detail in Example 11, below
Figure 7:
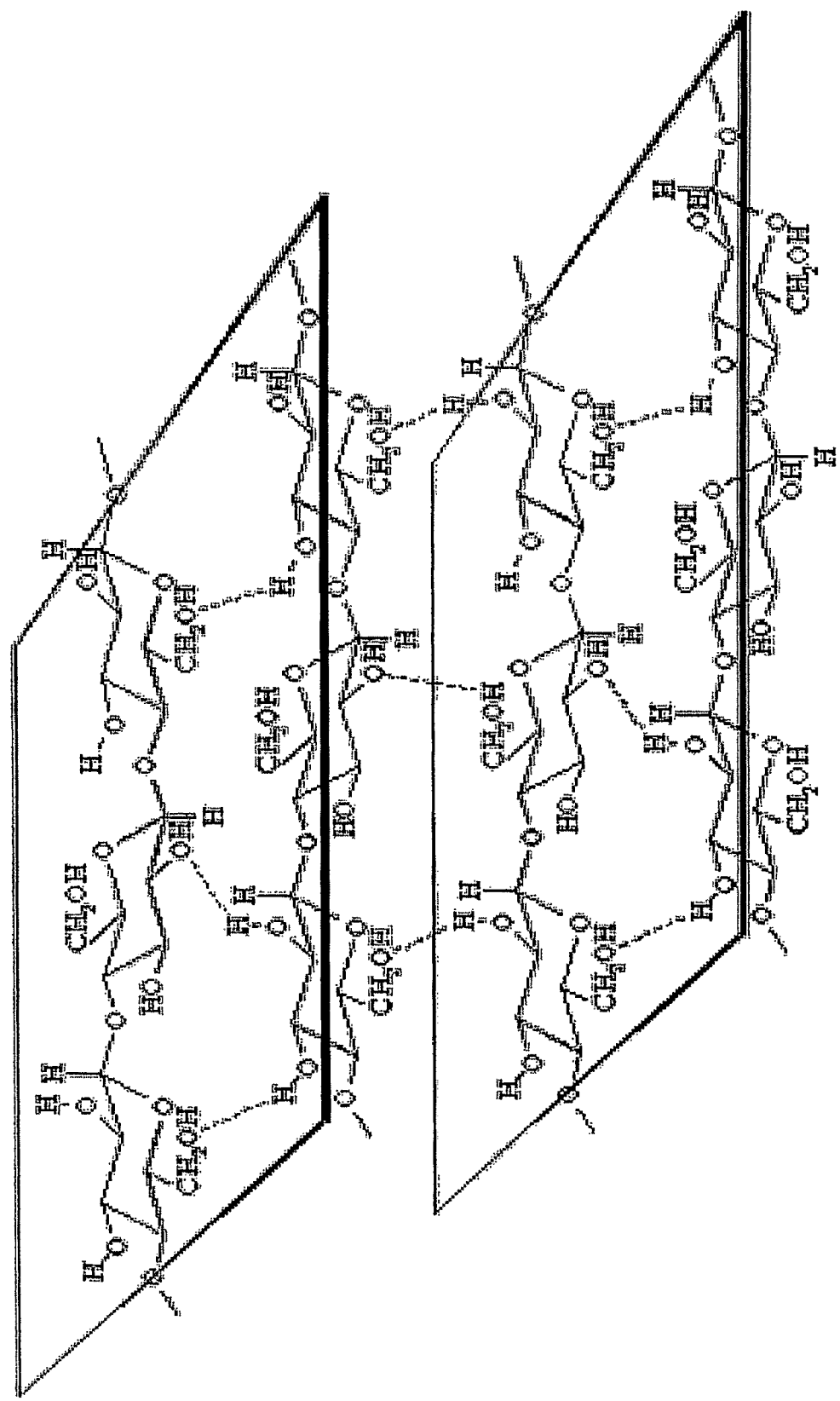
Figure 8:
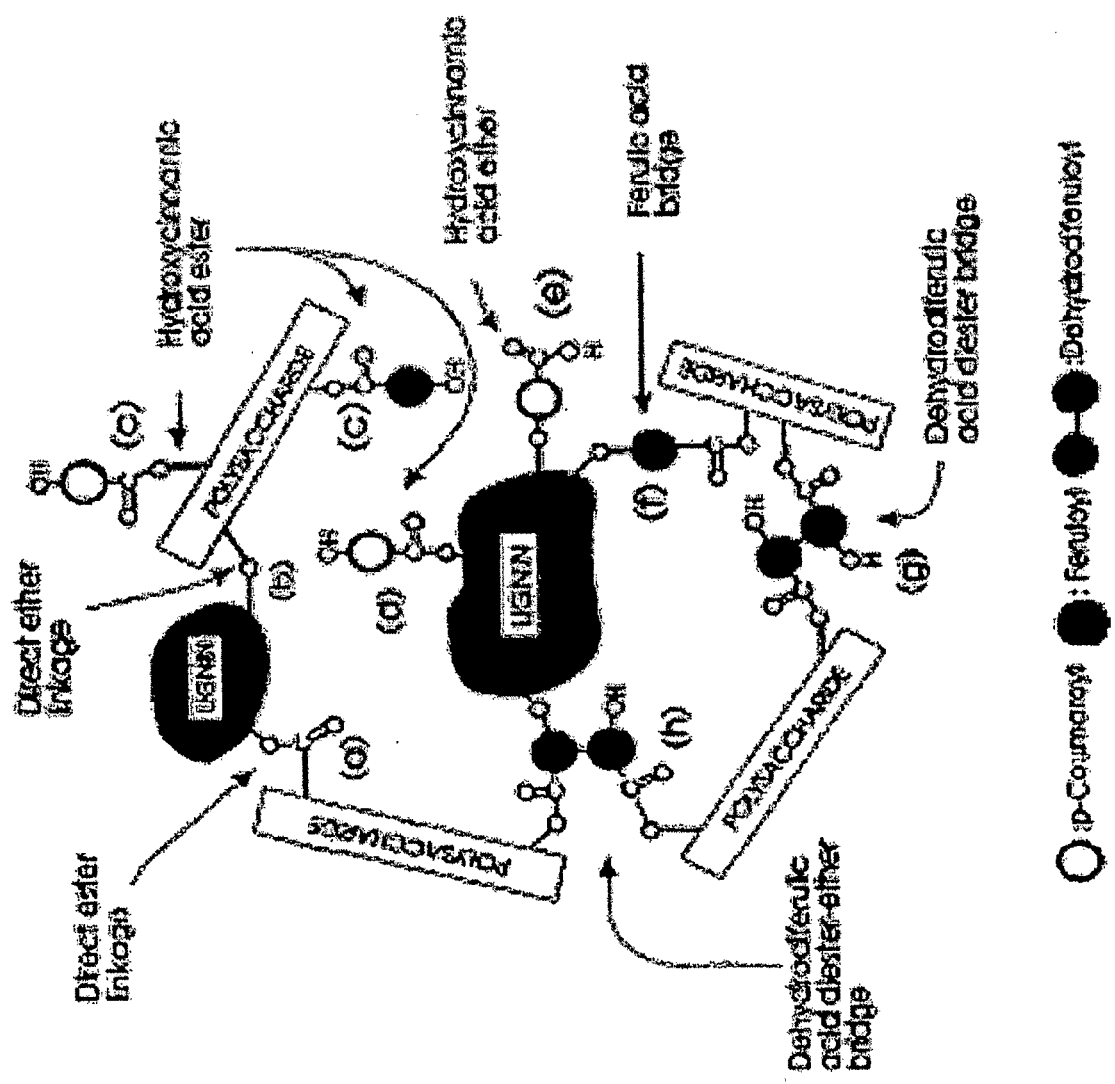
Figure 9:
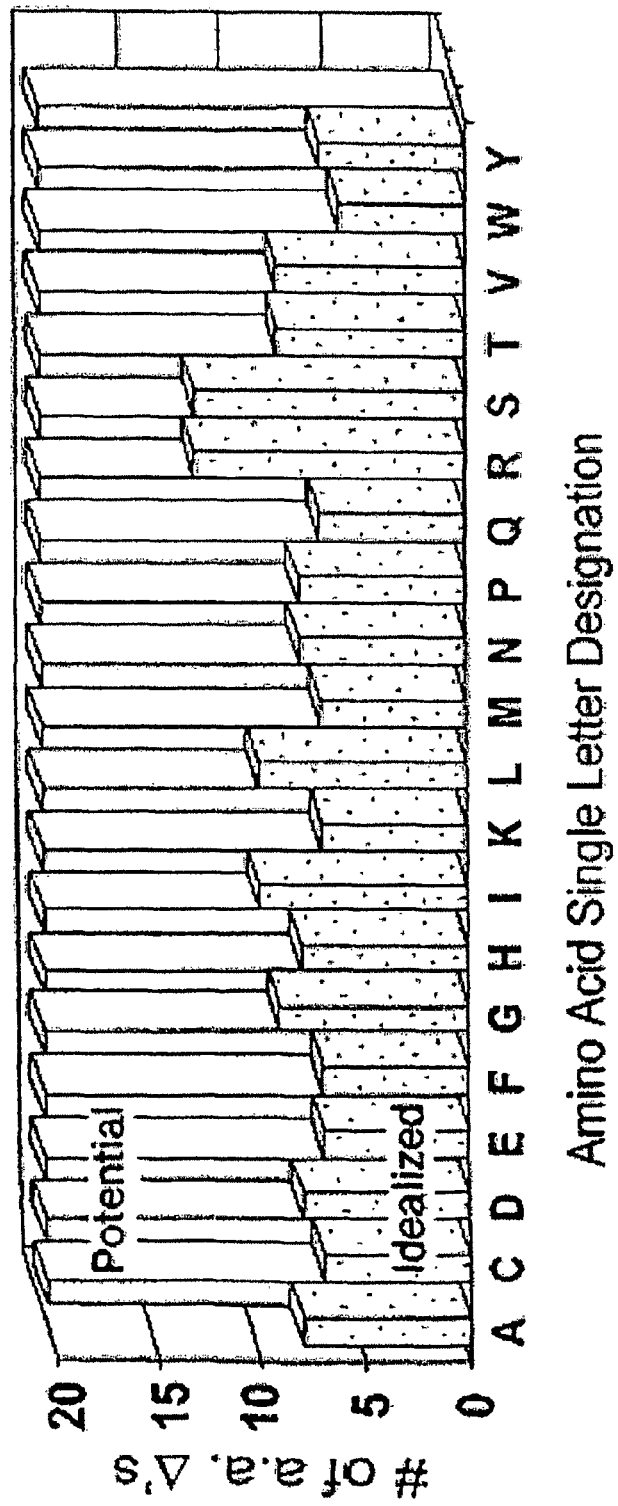
FIG. 9 is a diagram illustrating the variety of likely mutations in polypeptide that result from the introduction of single point mutations in a polynucleotide encoding said polypeptide by a method such as error-prone PCR. Because replicative errors in a polynucleotide sequence, such as those introduced using error-prone PCR are unlikely to generate two— much less three—contiguous nucleotide changes, said methods are unlikely to achieve more than 5-7 (on average) codon changes at each codon position. Illustrated is the poor ability of this approach for achieving all possible amino acid changes at each amino acid site along the polypeptide. In contrast, the gene site-saturation mutagenesis (GSSM) approach does achieve a range of codon substitutions (preferably comprising the 32 codons represented by the degenerate cassette sequence N,N,G/T) so as to achieve all possible amino acid changes at each amino acid site along a polypeptide.

FIG. 4 is a flow diagram illustrating one aspect of an identifier process 300 for detecting the presence of a feature in a sequence. The process 300 begins at a start state 302 and then moves to a state 304 wherein a first sequence that is to be checked for features is stored to a memory 115 in the computer system 100. The process 300 then moves to a state 306 wherein a database of sequence features is opened. Such a database would include a list of each feature's attributes along with the name of the feature. For example, a feature name could be "Initiation Codon" and the attribute would be "ATG". Another example would be the feature name "TAATAA Box" and the feature attribute would be "TAATAA". An example of such a database is produced by the University of Wisconsin Genetics Computer Group. Alternatively, the features may be structural polypeptide motifs such as alpha helices, beta sheets, or functional polypeptide motifs such as enzymatic active sites, helix-turn-helix motifs or other motifs known to those skilled in the art.

Once the database of features is opened at the state 306, the process 300 moves to a state 308 wherein the first feature is read from the database. A comparison of the attribute of the first feature with the first sequence is then made at a state 310. A determination is then made at a decision state 316 whether the attribute of the feature was found in the first sequence. If the attribute was found, then the process 300 moves to a state 318 wherein the name of the found feature is displayed to the user.

The process 300 then moves to a decision state 320 wherein a determination is made whether move features exist in the database. If no more features do exist, then the process 300 terminates at an end state 324. However, if more features do exist in the database, then the process 300 reads the next sequence feature at a state 326 and loops back to the state 310 wherein the attribute of the next feature is compared against the first sequence. It should be noted, that if the feature attribute is not found in the first sequence at the decision state 316, the process 300 moves directly to the decision state 320 in order to determine if any more features exist in the database.

Accordingly, another aspect of the invention is a method of identifying a feature within a nucleic acid sequence of the invention, or a polypeptide sequence of the invention, comprising reading the nucleic acid code(s) or polypeptide code(s) through the use of a computer program which identifies features therein and identifying features within the nucleic acid code(s) with the computer program. In one aspect, computer program comprises a computer program which identifies open reading frames. The method may be performed by reading a single sequence or at least 2, 5, 10, 15, 20, 25, 30, or 40 or more of the nucleic acid sequences of the invention, or the polypeptide sequences of the invention, through the use of the computer program and identifying features within the nucleic acid codes or polypeptide codes with the computer program.

A nucleic acid sequence of the invention, or a polypeptide sequence of the invention, may be stored and manipulated in a variety of data processor programs in a variety of formats. For example, a nucleic acid sequence of the invention, or a polypeptide sequence of the invention, may be stored as text in a word processing file, such as Microsoft WORD™ or WORDPERFECT™ or as an ASCII file in a variety of database programs familiar to those of skill in the art, such as DB2™, SYBASET™, or ORACLE™. In addition, many computer programs and databases may be used as sequence comparison algorithms, identifiers, or sources of reference nucleotide sequences or polypeptide sequences to be compared to a nucleic acid sequence of the invention, or a polypeptide sequence of the invention. The following list is intended not to limit the invention but to provide guidance to programs and databases which are useful with the nucleic acid sequences of the invention, or the polypeptide sequences of the invention.

The programs and databases which may be used include, but are not limited to: MACPATTERN™ (EMBL), DISCOVERYBASE™ (Molecular Applications Group), GENEMINE™ (Molecular Applications Group), LOOK™ (Molecular Applications Group), MACLOOK™ (Molecular Applications Group), BLAST and BLAST2 (NCBI), BLASTN and BLASTX (Altschul et al, J. Mol. Biol. 215: 403, 1990), FASTA (Pearson and Lipman, Proc. Natl. Acad. Sci. USA, 85: 2444, 1988), FASTDB (Brutlag et al. Comp. App. Biosci. 6:237-245, 1990), CATALYST™ (Molecular Simulations Inc.), Catalyst/SHAPE™ (Molecular Simulations Inc.), Cerius$^2$.DBAccess™ (Molecular Simulations Inc.), HYPOGEN™ (Molecular Simulations Inc.), INSIGHT II™, (Molecular Simulations Inc.), DISCOVER™ (Molecular Simulations Inc.), CHARMm™ (Molecular Simulations Inc.), FELIX™ (Molecular Simulations Inc.), DELPHI™, (Molecular Simulations Inc.), QuanteMM™, (Molecular Simulations Inc.), Homology (Molecular Simulations Inc.), MODELER™ (Molecular Simulations Inc.), ISIS™ (Molecular Simulations Inc.), Quanta/Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the MDL Available Chemicals Directory database, the MDL Drug Data Report data base, the Comprehensive Medicinal Chemistry database, Derwents's World Drug Index database, the BioByteMasterFile database, the Genbank database and the Genseqn database. Many other programs and data bases would be apparent to one of skill in the art given the present disclosure.

Motifs which may be detected using the above programs include sequences encoding leucine zippers, helix-turn-helix motifs, glycosylation sites, ubiquitination sites, alpha helices and beta sheets, signal sequences encoding signal peptides which direct the secretion of the encoded proteins, sequences implicated in transcription regulation such as homeoboxes, acidic stretches, enzymatic active sites, substrate binding sites and enzymatic cleavage sites.

Hybridization of Nucleic Acids

The invention provides isolated, synthetic or recombinant nucleic acids that hybridize under stringent conditions to an exemplary sequence of the invention (e.g., SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:1149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287, SEQ ID NO:289, SEQ ID NO:291, SEQ ID NO:293, SEQ ID NO:295, SEQ ID NO:297, SEQ ID NO:299, SEQ ID NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377, SEQ ID NO:379, SEQ ID NO:381, SEQ ID NO:383, SEQ ID NO:385, SEQ ID NO:387, SEQ ID NO:389, SEQ ID NO:391, SEQ ID NO:393, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO:415, SEQ ID NO:417, SEQ ID NO:419, SEQ ID NO:421, SEQ ID NO:423, SEQ ID NO:425, SEQ ID NO:427, SEQ ID NO:429, SEQ ID NO:431, SEQ ID NO:433, SEQ ID NO: 435, SEQ ID NO:437, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:475, SEQ ID NO:477, SEQ ID NO:479, SEQ ID NO:481, SEQ ID NO:483, SEQ ID NO:485, SEQ ID NO:487, SEQ ID NO:489, SEQ ID NO:491, SEQ ID NO:493, SEQ ID NO:495, SEQ ID NO:497, SEQ ID NO:499, SEQ ID NO:501, SEQ ID NO:503, SEQ ID NO:505, SEQ ID NO:507, SEQ ID NO:509, SEQ ID NO:511, SEQ ID NO:513, SEQ ID NO:515, SEQ ID NO:517, SEQ ID NO:519, SEQ ID NO:521 and/or SEQ ID NO:523 see also Tables 1, 2, and 3, Examples 1 and 4, below, and Sequence Listing)). The stringent conditions can be highly stringent conditions, medium stringent conditions and/or low stringent conditions, including the high and reduced stringency conditions described herein. In one aspect, it is the stringency of the wash conditions that set forth the conditions which determine whether a nucleic acid is within the scope of the invention, as discussed below.

"Hybridization" refers to the process by which a nucleic acid strand joins with a complementary strand through base pairing. Hybridization reactions can be sensitive and selective so that a particular sequence of interest can be identified even in samples in which it is present at low concentrations. Suitably stringent conditions can be defined by, for example, the concentrations of salt or formamide in the prehybridization and hybridization solutions, or by the hybridization temperature and are well known in the art. In alternative aspects, stringency can be increased by reducing the concentration of salt, increasing the concentration of formamide, or raising the hybridization temperature. In alternative aspects, nucleic acids of the invention are defined by their ability to hybridize under various stringency conditions (e.g., high, medium, and low), as set forth herein.

In one aspect, hybridization under high stringency conditions comprise about 50% formamide at about 37° C. to 42° C. In one aspect, hybridization conditions comprise reduced stringency conditions in about 35% to 25% formamide at about 30° C. to 35° C. In one to aspect, hybridization conditions comprise high stringency conditions, e.g., at 42° C. in 50% formamide, 5×SSPE, 0.3% SDS and 200 ug/ml sheared and denatured salmon sperm DNA. In one aspect, hybridization conditions comprise these reduced stringency conditions, but in 35% formamide at a reduced temperature of 35° C. The temperature range corresponding to a particular level of stringency can be further narrowed by calculating the purine to pyrimidine ratio of the nucleic acid of interest and adjusting the temperature accordingly. Variations on the above ranges and conditions are well known in the art.

In alternative aspects, nucleic acids of the invention as defined by their ability to hybridize under stringent conditions can be between about five residues and the full length of nucleic acid of the invention; e.g., they can be at least 5, 10, 15, 20, 25, 30, 35, 40, 50, 55, 60, 65, 70, 75, 80, 90, 100, 150, 200, 250, 300, 350, 400, 450, 500, 550, 600, 650, 700, 750, 800, 850, 900, 950, 1000, or more, residues in length. Nucleic acids shorter than full length are also included. These nucleic acids can be useful as, e.g., hybridization probes, labeling probes, PCR oligonucleotide probes, siRNA or miRNA (single or double stranded), antisense or sequences encoding antibody binding peptides (epitopes), motifs, active sites and the like.

In one aspect, nucleic acids of the invention are defined by their ability to hybridize under high stringency comprises conditions of about 50% formamide at about 37° C. to 42° C. In one aspect, nucleic acids of the invention are defined by their ability to hybridize under reduced stringency comprising conditions in about 35% to 25% formamide at about 30° C. to 35° C.

Alternatively, nucleic acids of the invention are defined by their ability to hybridize under high stringency comprising conditions at 42° C. in 50% formamide, 5×SSPE, 0.3% SDS, and a repetitive sequence blocking nucleic acid, such as cot-1 or salmon sperm DNA (e.g., 200 ug/ml sheared and denatured salmon sperm DNA). In one aspect, nucleic acids of the invention are defined by their ability to hybridize under reduced stringency conditions comprising 35% or 40% formamide at a reduced temperature of 35° C. or 42° C.

In nucleic acid hybridization reactions, the conditions used to achieve a particular level of stringency will vary, depending on the nature of the nucleic acids being hybridized. For example, the length, degree of complementarity, nucleotide sequence composition (e.g., GC v. AT content) and nucleic acid type (e.g., RNA v. DNA) of the hybridizing regions of the nucleic acids can be considered in selecting hybridization conditions. An additional consideration is whether one of the nucleic acids is immobilized, for example, on a filter.

Hybridization may be carried out under conditions of low stringency, moderate stringency or high stringency. As an example of nucleic acid hybridization, a polymer membrane containing immobilized denatured nucleic acids is first prehybridized for 30 minutes at 45° C. in a solution consisting of 0.9 M NaCl, 50 mM $NaH_2PO_4$, pH 7.0, 5.0 mM $Na_2EDTA$, 0.5% SDS, 10×Denhardt's and 0.5 mg/ml polyriboadenylic acid. Approximately $2×10^7$ cpm (specific activity $4-9×10^8$ cpm/ug) of $^{32}P$ end-labeled oligonucleotide probe are then added to the solution. After 12-16 hours of incubation, the membrane is washed for 30 minutes at room temperature in 1×SET (150 mM NaCl, 20 mM Tris hydrochloride, pH 7.8, 1 mM $Na_2EDTA$) containing 0.5% SDS, followed by a 30 minute wash in fresh 1×SET at $T_m$-10° C. for the oligonucleotide probe. The membrane is then exposed to auto-radiographic film for detection of hybridization signals. All of the foregoing hybridizations would be considered to be under conditions of high stringency.

Following hybridization, a filter can be washed to remove any non-specifically bound detectable probe. The stringency used to wash the filters can also be varied depending on the nature of the nucleic acids being hybridized, the length of the nucleic acids being hybridized, the degree of complementarity, the nucleotide sequence composition (e.g., GC v. AT content) and the nucleic acid type (e.g., RNA v. DNA). Examples of progressively higher stringency condition washes are as follows: 2×SSC, 0.1% SDS at room temperature for 15 minutes (low stringency); 0.1×SSC, 0.5% SDS at room temperature for 30 minutes to 1 hour (moderate stringency); 0.1×SSC, 0.5% SDS for 15 to 30 minutes at between the hybridization temperature and 68° C. (high stringency); and 0.15M NaCl for 15 minutes at 72° C. (very high stringency). A final low stringency wash can be conducted in 0.1×SSC at room temperature. The examples above are merely illustrative of one set of conditions that can be used to wash filters. One of skill in the art would lnow that there are numerous recipes for different stringency washes. Some other examples are given below.

In one aspect, hybridization conditions comprise a wash step comprising a wash for 30 minutes at room temperature in a solution comprising 1×150 mM NaCl, 20 mM Tris hydrochloride, pH 7.8, 1 mM $Na_2EDTA$, 0.5% SDS, followed by a 30 minute wash in fresh solution.

Nucleic acids which have hybridized to the probe are identified by autoradiography or other conventional techniques.

The above procedures may be modified to identify nucleic acids having decreasing levels of sequence identity (homology) to the probe sequence. For example, to obtain nucleic acids of decreasing sequence identity (homology) to the detectable probe, less stringent conditions may be used. For example, the hybridization temperature may be decreased in increments of 5° C. from 68° C. to 42° C. in a hybridization buffer having a $Na^+$ concentration of approximately 1M. Following hybridization, the filter may be washed with 2×SSC, 0.5% SDS at the temperature of hybridization. These conditions are considered to be "moderate" conditions above 50° C. and "low" conditions below 50° C. A specific example of "moderate" hybridization conditions is when the above hybridization is conducted at 55° C. A specific example of "low stringency" hybridization conditions is when the above hybridization is conducted at 45° C.

Alternatively, the hybridization may be carried out in buffers, such as 6×SSC, containing formamide at a temperature of 42° C. In this case, the concentration of formamide in the hybridization buffer may be reduced in 5% increments from 50% to 0% to identify clones having decreasing levels of homology to the probe. Following hybridization, the filter may be washed with 6×SSC, 0.5% SDS at 50° C. These conditions are considered to be "moderate" conditions above 25% formamide and "low" conditions below 25% formamide. A specific example of "moderate" hybridization conditions is when the above hybridization is conducted at 30% formamide. A specific example of "low stringency" hybridization conditions is when the above hybridization is conducted at 10% formamide.

However, the selection of a hybridization format may not be critical—it is the stringency of the wash conditions that set forth the conditions which determine whether a nucleic acid is within the scope of the invention. Wash conditions used to identify nucleic acids within the scope of the invention include, e.g.: a salt concentration of about 0.02 molar at pH 7 and a temperature of at least about 50° C. or about 55° C. to about 60° C.; or, a salt concentration of about 0.15 M NaCl at 72° C. for about 15 minutes; or, a salt concentration of about 0.2×SSC at a temperature of at least about 50° C. or about 55° C. to about 60° C. for about 15 to about 20 minutes; or, the hybridization complex is washed twice with a solution with a salt concentration of about 2×SSC containing 0.1% SDS at room temperature for 15 minutes and then washed twice by 0.1×SSC containing 0.1% SDS at 68° C. for 15 minutes; or, equivalent conditions. See Sambrook, Tijssen and Ausubel for a description of SSC buffer and equivalent conditions.

These methods may be used to isolate or identify nucleic acids of the invention. For example, the preceding methods may be used to isolate or identify nucleic acids having a sequence with at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more sequence identity (homology) to a nucleic acid sequence selected from the group consisting of one of the sequences of the invention, or fragments comprising at least about 10, 15, 20, 25, 30, 35, 40, 50, 75, 100, 150, 200, 300, 400, or 500 consecutive bases thereof and the sequences complementary thereto. Sequence identity (homology) may be measured using the alignment algorithm. For example, the homologous polynucleotides may have a coding sequence which is a naturally occurring allelic variant of one of the coding sequences described herein. Such allelic variants may have a substitution, deletion or addition of one or more nucleotides when compared to the nucleic acids of the invention. Additionally, the above procedures may be used to isolate nucleic acids which encode polypeptides having at least about 99%, 95%, at least 90%, at least 85%, at least 80%, at least 75%, at least 70%, at least 65%, at least 60%, at least 55%, or at least 50% sequence identity (homology) to a polypeptide of the invention, or fragments comprising at least 5, 10, 15, 20, 25, 30, 35, 40, 50, 75, 100, or 150 consecutive amino acids thereof as determined using a sequence alignment algorithm (e.g., such as the FASTA version 3.0t78 algorithm with the default parameters).

Oligonucleotides Probes and Methods for Using them

The invention also provides nucleic acid probes that can be used, e.g., for identifying, amplifying, or isolating nucleic acids encoding a polypeptide having a cellulase, e.g., endoglucanase, cellobiohydrolase, beta-glucosidase, xylanase, mannanse, β-xylosidase, arabinofuranosidase, and/or oligomerase enzyme activity or fragments thereof or for identifying cellulase, e.g., endoglucanase, cellobiohydrolase, beta-glucosidase, xylanase, mannanse, β-xylosidase, arabinofuranosidase, and/or oligomerase enzyme genes. In one aspect, the probe comprises at least about 10 consecutive bases of a nucleic acid of the invention. Alternatively, a probe of the invention can be at least about 5, 6, 7, 8, 9, 10, 11, 12, 13, 14, 15, 16, 17, 18, 19, 20, 21, 22, 23, 24, 25, 30, 35, 40, 45, 50, 60, 70, 80, 90, 100, 110, 120, 130, 150 or about 10 to 50, about 20 to 60 about 30 to 70, consecutive bases of a sequence of a nucleic acid of the invention. The probes identify a nucleic acid by binding and/or hybridization. The probes can be used in arrays of the invention, see discussion below, including, e.g., capillary arrays. The probes of the invention can also be used to isolate other nucleic acids or polypeptides.

The isolated, synthetic or recombinant nucleic acids of the invention, the sequences complementary thereto, or a fragment comprising at least about 10, 15, 20, 25, 30, 35, 40, 50, 75, 100, 150, 200, 300, 400, or 500 consecutive bases of one of the sequences of the invention, or the sequences complementary thereto may also be used as probes to determine whether a biological sample, such as a soil sample, contains an organism having a nucleic acid sequence of the invention or an organism from which the nucleic acid was obtained. In such procedures, a biological sample potentially harboring the organism from which the nucleic acid was isolated is obtained and nucleic acids are obtained from the sample. The nucleic acids are contacted with the probe under conditions which permit the probe to specifically hybridize to any complementary sequences from which are present therein.

Where necessary, conditions which permit the probe to specifically hybridize to complementary sequences may be determined by placing the probe in contact with complementary sequences from samples known to contain the complementary sequence as well as control sequences which do not contain the complementary sequence. Hybridization conditions, such as the salt concentration of the hybridization buffer, the formamide concentration of the hybridization buffer, or the hybridization temperature, may be varied to identify conditions which allow the probe to hybridize specifically to complementary nucleic acids.

If the sample contains the organism from which the nucleic acid was isolated, specific hybridization of the probe is then detected. Hybridization may be detected by labeling the probe with a detectable agent such as a radioactive isotope, a fluorescent dye or an enzyme capable of catalyzing the formation of a detectable product.

Many methods for using the labeled probes to detect the presence of complementary nucleic acids in a sample are familiar to those skilled in the art. These include Southern Blots, Northern Blots, colony hybridization procedures and dot blots. Protocols for each of these procedures are provided in Ausubel et al. Current Protocols in Molecular Biology, John Wiley 503 Sons, Inc. (1997) and Sambrook et al., Molecular Cloning: A Laboratory Manual 2nd Ed., Cold Spring Harbor Laboratory Press (1989.

Alternatively, more than one probe (at least one of which is capable of specifically hybridizing to any complementary sequences which are present in the nucleic acid sample), may be used in an amplification reaction to determine whether the sample contains an organism containing a nucleic acid sequence of the invention (e.g., an organism from which the nucleic acid was isolated). In one aspect, the probes comprise oligonucleotides. In one aspect, the amplification reaction may comprise a PCR reaction. PCR protocols are described in Ausubel and Sambrook, supra. Alternatively, the amplification may comprise a ligase chain reaction, 3SR, or strand displacement reaction. (See Barany, F., "The Ligase Chain Reaction in a PCR World", *PCR Methods and Applications* 1:5-16, 1991; E. Fahy et al., "Self-sustained Sequence Replication (3SR): An Isothermal Transcription-based Amplification System Alternative to PCR", *PCR Methods and Applications* 1:25-33, 1991; and Walker G. T. et al., "Strand Displacement Amplification-an Isothermal in vitro DNA Amplification Technique", *Nucleic Acid Research* 20:1691-1696, 1992). In such procedures, the nucleic acids in the sample are contacted with the probes, the amplification reaction is performed and any resulting amplification product is detected. The amplification product may be detected by performing gel electrophoresis on the reaction products and staining the gel with an intercalator such as ethidium bromide. Alternatively, one or more of the probes may be labeled with a radioactive isotope and the presence of a radioactive amplification product may be detected by autoradiography after gel electrophoresis.

Probes derived from sequences near the ends of the sequences of the invention, may also be used in chromosome walking procedures to identify clones containing genomic sequences located adjacent to the sequences of the invention. Such methods allow the isolation of genes which encode additional proteins from the host organism.

In one aspect, the isolated, synthetic or recombinant nucleic acids of the invention, the sequences complementary thereto, or a fragment comprising at least 10, 15, 20, 25, 30, 35, 40, 50, 75, 100, 150, 200, 300, 400, or 500 or more consecutive bases of one of the sequences of the invention, or the sequences complementary thereto are used as probes to identify and isolate related nucleic acids. In some aspects, the related nucleic acids may be cDNAs or genomic DNAs from organisms other than the one from which the nucleic acid was isolated. For example, the other organisms may be related organisms. In such procedures, a nucleic acid sample is contacted with the probe under conditions which permit the probe to specifically hybridize to related sequences. Hybridization of the probe to nucleic acids from the related organism is then detected using any of the methods described above.

By varying the stringency of the hybridization conditions used to identify nucleic acids, such as cDNAs or genomic DNAs, which hybridize to the detectable probe, nucleic acids having different levels of homology to the probe can be identified and isolated. Stringency may be varied by conducting the hybridization at varying temperatures below the melting temperatures of the probes. The melting temperature, $T_m$, is the temperature (under defined ionic strength and pH) at which 50% of the target sequence hybridizes to a perfectly complementary probe. Very stringent conditions are selected to be equal to or about 5° C. lower than the $T_m$ for a particular probe. The melting temperature of the probe may be calculated using the following formulas:

For probes between 14 and 70 nucleotides in length the melting temperature ($T_m$) is calculated using the formula: $T_m=81.5+16.6(\log [Na+])+0.41(\text{fraction } G+C)-(600/N)$ where N is the length of the probe.

If the hybridization is carried out in a solution containing formamide, the melting temperature may be calculated using the equation: $T_m=81.5+16.6(\log [Na+])+0.41(\text{fraction } G+C)-(0.63\% \text{ formamide})-(600/N)$ where N is the length of the probe.

Prehybridization may be carried out in 6×SSC, 5×Denhardt's reagent, 0.5% SDS, 100 μg/ml denatured fragmented salmon sperm DNA or 6×SSC, 5×Denhardt's reagent, 0.5% SDS, 100 μg/ml denatured fragmented salmon sperm DNA, 50% formamide. The formulas for SSC and Denhardt is solutions are listed in Sambrook et al., supra.

In one aspect, hybridization is conducted by adding the detectable probe to the prehybridization solutions listed above. Where the probe comprises double stranded DNA, it is denatured before addition to the hybridization solution. In one aspect, the filter is contacted with the hybridization solution for a sufficient period of time to allow the probe to hybridize to cDNAs or genomic DNAs containing sequences complementary thereto or homologous thereto. For probes over 200 nucleotides in length, the hybridization may be carried out at 15-25° C. below the $T_m$. For shorter probes, such as oligonucleotide probes, the hybridization may be conducted at 5-10° C. below the $T_m$. In one aspect, for hybridizations in 6×SSC, the hybridization is conducted at approximately 68° C. Usually, for hybridizations in 50% formamide containing solutions, the hybridization is conducted at approximately 42° C.

Inhibiting Expression of Cellulase Enzymes

The invention provides nucleic acids complementary to (e.g., antisense sequences to) the nucleic acids of the invention, e.g., cellulase enzyme-encoding nucleic acids, e.g., nucleic acids comprising antisense, siRNA, miRNA, ribozymes. Nucleic acids of the invention comprising antisense sequences can be capable of inhibiting the transport, splicing or transcription of cellulase enzyme-encoding genes. The inhibition can be effected through the targeting of genomic DNA or messenger RNA. The transcription or function of targeted nucleic acid can be inhibited, for example, by hybridization and/or cleavage. One exemplary set of inhibitors provided by the present invention includes oligonucleotides which are able to either bind cellulase, e.g., endoglucanase, cellobiohydrolase, beta-glucosidase, xylanase, mannanse, β-xylosidase, arabinofuranosidase, and/or oligomerase enzyme gene or message, in either case preventing or inhibiting the production or function of a cellulase, e.g., endoglucanase, cellobiohydrolase, beta-glucosidase, xylanase, mannanse, β-xylosidase, arabinofuranosidase, and/or oligomerase enzyme. The association can be through sequence specific hybridization. Another useful class of inhibitors includes oligonucleotides which cause inactivation or cleavage of cellulase, e.g., endoglucanase, cellobiohydrolase, beta-glucosidase, xylanase, mannanse, β-xylosidase, arabinofuranosidase, and/or oligomerase enzyme message. The oligonucleotide can have enzyme activity which causes such cleavage, such as ribozymes. The oligonucleotide can be chemically modified or conjugated to an enzyme or composition capable of cleaving the complementary nucleic acid. A pool of many different such oligonucleotides can be screened for those with the desired activity. Thus, the invention provides various compositions for the inhibition of cellulase, e.g., endoglucanase, cellobiohydrolase, beta-glucosidase, xylanase, mannanse, β-xylosidase, arabinofuranosidase, and/or oligomerase enzyme expression on a nucleic acid and/or protein level, e.g., antisense, siRNA, miRNA and ribozymes comprising cellulase, e.g., endoglucanase, cellobiohydrolase, beta-glucosidase, xylanase, mannanse, β-xylosidase, arabinofuranosidase, and/or oligomerase enzyme sequences of the invention and the anti-cellulase, e.g., anti-endoglucanase, anti-cellobiohydrolase and/or anti-beta-glucosidase antibodies of the invention.

Inhibition of cellulase, e.g., endoglucanase, cellobiohydrolase, beta-glucosidase, xylanase, mannanse, β-xylosidase, arabinofuranosidase, and/or oligomerase enzyme expression can have a variety of industrial applications. For example, inhibition of cellulase, e.g., endoglucanase, cellobiohydrolase, beta-glucosidase, xylanase, mannanse, β-xylosidase, arabinofuranosidase, and/or oligomerase enzyme expression can slow or prevent spoilage. In one aspect, use of compositions of the invention that inhibit the expression and/or activity of cellulase, e.g., endoglucanase, cellobiohydrolase, beta-glucosidase, xylanase, mannanse, β-xylosidase, arabinofuranosidase, and/or oligomerase enzymes, e.g., antibodies, antisense oligonucleotides, ribozymes, siRNA and miRNA are used to slow or prevent spoilage. Thus, in one aspect, the invention provides methods and compositions comprising application onto a plant or plant product (e.g., a cereal, a grain, a fruit, seed, root, leaf, etc.) antibodies, antisense oligonucleotides, ribozymes, siRNA and miRNA of the invention to slow or prevent spoilage. These compositions also can be expressed by the plant (e.g., a transgenic plant) or another organism (e.g., a bacterium or other microorganism transformed with a cellulase, e.g., endoglucanase, cellobiohydrolase, beta-glucosidase, xylanase, mannanse, β-xylosidase, arabinofuranosidase, and/or oligomerase enzyme gene of the invention).

The compositions of the invention for the inhibition of cellulase, e.g., endoglucanase, cellobiohydrolase, beta-glucosidase, xylanase, mannanse, β-xylosidase, arabinofuranosidase, and/or oligomerase enzyme expression (e.g., antisense, iRNA, ribozymes, antibodies) can be used as pharmaceutical compositions, e.g., as anti-pathogen agents or in other therapies, e.g., as anti-microbials for, e.g., *Salmonella*.

Antisense Oligonucleotides

The invention provides antisense oligonucleotides capable of binding cellulase, e.g., endoglucanase, cellobiohydrolase, beta-glucosidase, xylanase, mannanse, β-xylosidase, arabinofuranosidase, and/or oligomerase enzyme message which, in one aspect, can inhibit cellulase, e.g., endoglucanase, cellobiohydrolase, beta-glucosidase, xylanase, mannanse, β-xylosidase, arabinofuranosidase, and/or oligomerase enzyme activity by targeting mRNA. Strategies for designing antisense oligonucleotides are well described in the scientific and patent literature, and the skilled artisan can design such cellulase, e.g., endoglucanase, cellobiohydrolase, beta-glucosidase, xylanase, mannanse, β-xylosidase, arabinofuranosidase, and/or oligomerase enzyme oligonucleotides using the novel reagents of the invention. For example, gene walking/RNA mapping protocols to screen for effective antisense oligonucleotides are well known in the art, see, e.g., Ho (2000) Methods Enzymol. 314:168-183, describing an RNA mapping assay, which is based on standard molecular techniques to provide an easy and reliable method for potent antisense sequence selection. See also Smith (2000) Eur. J. Pharm. Sci. 11:191-198.

Naturally occurring nucleic acids are used as antisense oligonucleotides. The antisense oligonucleotides can be of any length; for example, in alternative aspects, the antisense oligonucleotides are between about 5 to 100, about 10 to 80, about 15 to 60, about 18 to 40. The optimal length can be determined by routine screening. The antisense oligonucleotides can be present at any concentration. The optimal concentration can be determined by routine screening. A wide variety of synthetic, non-naturally occurring nucleotide and nucleic acid analogues are known which can address this potential problem. For example, peptide nucleic acids (PNAs) containing non-ionic backbones, such as N-(2-aminoethyl)glycine units can be used. Antisense oligonucleotides having phosphorothioate linkages can also be used, as described in WO 97/03211; WO 96/39154; Mata (1997) Toxicol Appl Pharmacol 144:189-197; Antisense Therapeutics, ed. Agrawal (Humana Press, Totowa, N.J., 1996). Antisense oligonucleotides having synthetic DNA backbone analogues provided by the invention can also include phosphorodithioate, methylphosphonate, phosphoramidate, alkyl phosphotriester, sulfamate, 3'-thioacetal, methylene(methylimino), 3'-N-carbamate, and morpholino carbamate nucleic acids, as described above.

Combinatorial chemistry methodology can be used to create vast numbers of oligonucleotides that can be rapidly screened for specific oligonucleotides that have appropriate binding affinities and specificities toward any target, such as the sense and antisense cellulase, e.g., endoglucanase, cellobiohydrolase, beta-glucosidase, xylanase, mannanse, β-xylosidase, arabinofuranosidase, and/or oligomerase enzyme sequences of the invention (see, e.g., Gold (1995) J. of Biol. Chem. 270:13581-13584).

Inhibitory Ribozymes

The invention provides ribozymes capable of binding cellulase, e.g., endoglucanase, cellobiohydrolase, beta-glucosidase, xylanase, mannanse, β-xylosidase, arabinofuranosidase, and/or oligomerase enzyme message. These ribozymes can inhibit cellulase, e.g., endoglucanase, cellobiohydrolase, beta-glucosidase, xylanase, mannanse, β-xylosidase, arabinofuranosidase, and/or oligomerase enzyme activity by, e.g., targeting mRNA. Strategies for designing ribozymes and selecting the cellulase, e.g., endoglucanase, cellobiohydrolase, beta-glucosidase, xylanase, mannanse, β-xylosidase, arabinofuranosidase, and/or oligomerase enzyme-specific antisense sequence for targeting are well described in the scientific and patent literature, and the skilled artisan can design such ribozymes using the novel reagents of the invention. Ribozymes act by binding to a target RNA through the target RNA binding portion of a ribozyme which is held in close proximity to an enzymatic portion of the RNA that cleaves the target RNA. Thus, the ribozyme recognizes and binds a target RNA through complementary base-pairing, and once bound to the correct site, acts enzymatically to cleave and inactivate the target RNA. Cleavage of a target RNA in such a manner will destroy its ability to direct synthesis of an encoded protein if the cleavage occurs in the coding sequence. After a ribozyme has bound and cleaved its RNA target, it can be released from that RNA to bind and cleave new targets repeatedly.

In some circumstances, the enzymatic nature of a ribozyme can be advantageous over other technologies, such as antisense technology (where a nucleic acid molecule simply binds to a nucleic acid target to block its transcription, translation or association with another molecule) as the effective concentration of ribozyme necessary to effect a therapeutic treatment can be lower than that of an antisense oligonucleotide. This potential advantage reflects the ability of the ribozyme to act enzymatically. Thus, a single ribozyme molecule is able to cleave many molecules of target RNA. In one aspect, a ribozyme is a highly specific inhibitor, with the specificity of inhibition depending not only on the base pairing mechanism of binding, but also on the mechanism by which the molecule inhibits the expression of the RNA to which it binds. That is, the inhibition is caused by cleavage of the RNA target and so specificity is defined as the ratio of the rate of cleavage of the targeted RNA over the rate of cleavage of non-targeted RNA. This cleavage mechanism is dependent upon factors additional to those involved in base pairing. Thus, the specificity of action of a ribozyme can be greater than that of antisense oligonucleotide binding the same RNA site.

The ribozyme of the invention, e.g., an enzymatic ribozyme RNA molecule, can be formed in a hammerhead motif, a hairpin motif, as a hepatitis delta virus motif, a group I intron motif and/or an RNaseP-like RNA in association with an RNA guide sequence. Examples of hammerhead motifs are described by, e.g., Rossi (1992) Aids Research and Human Retroviruses 8:183; hairpin motifs by Hampel (1989) Biochemistry 28:4929, and Hampel (1990) Nuc. Acids Res. 18:299; the hepatitis delta virus motif by Perrotta (1992) Biochemistry 31:16; the RNaseP motif by Guerrier-Takada (1983) Cell 35:849; and the group I intron by Cech U.S. Pat. No. 4,987,071. The recitation of these specific motifs is not intended to be limiting. Those skilled in the art will recognize that a ribozyme of the invention, e.g., an enzymatic RNA molecule of this invention, can have a specific substrate binding site complementary to one or more of the target gene RNA regions. A ribozyme of the invention can have a nucleotide sequence within or surrounding that substrate binding site which imparts an RNA cleaving activity to the molecule.

RNA Interference (RNAi)

In one aspect, the invention provides an RNA inhibitory molecule, a so-called "RNAi" molecule, comprising a cellulase, e.g., endoglucanase, cellobiohydrolase, beta-glucosidase, xylanase, mannanse, β-xylosidase, arabinofuranosidase, and/or oligomerase enzyme sequence of the invention. The RNAi molecule can comprise a double-stranded RNA (dsRNA) molecule, e.g., siRNA and/or miRNA. The RNAi molecule, e.g., siRNA and/or miRNA, can inhibit expression of a cellulase, e.g., endoglucanase, cellobiohydrolase, beta-glucosidase, xylanase, mannanse, β-xylosidase, arabinofuranosidase, and/or oligomerase enzyme gene. In one aspect, the RNAi molecule, e.g., siRNA and/or miRNA, is about 15, 16, 17, 18, 19, 20, 21, 22, 23, 24, 25 or more duplex nucleotides in length. While the invention is not limited by any particular mechanism of action, the RNAi can enter a cell and cause the degradation of a single-stranded RNA (ssRNA) of similar or identical sequences, including endogenous mRNAs. When a cell is exposed to double-stranded RNA (dsRNA), mRNA from the homologous gene is selectively degraded by a process called RNA interference (RNAi). A possible basic mechanism behind RNAi is the breaking of a double-stranded RNA (dsRNA) matching a specific gene sequence into short pieces called short interfering RNA, which trigger the degradation of mRNA that matches its sequence. In one aspect, the RNAi's of the invention are used in gene-silencing therapeutics, see, e.g., Shuey (2002) Drug Discov. Today 7:1040-1046. In one aspect, the invention provides methods to selectively degrade RNA using the RNAi's molecules, e.g., siRNA and/or miRNA, of the invention. The process may be practiced in vitro, ex vivo or in vivo. In one aspect, the RNAi molecules of the invention can be used to generate a loss-of-function mutation in a cell, an organ or an animal. Methods for making and using RNAi molecules, e.g., siRNA and/or miRNA, for selectively degrade RNA are well known in the art, see, e.g., U.S. Pat. Nos. 6,506,559; 6,511,824; 6,515,109; 6,489,127.

Modification of Nucleic Acids—Making Variant Enzymes of the Invention

The invention provides methods of generating variants of the nucleic acids of the invention, e.g., those encoding a cellulase, e.g., endoglucanase, cellobiohydrolase, beta-glucosidase, xylanase, mannanse, β-xylosidase, arabinofuranosidase, and/or oligomerase enzyme. These methods can be repeated or used in various combinations to generate cellulase, e.g., endoglucanase, cellobiohydrolase, beta-glucosidase, xylanase, mannanse, β-xylosidase, arabinofuranosidase, and/or oligomerase enzymes having an altered or different activity or an altered or different stability from that of a cellulase, e.g., endoglucanase, cellobiohydrolase, beta-glucosidase, xylanase, mannanse, β-xylosidase, arabinofuranosidase, and/or oligomerase enzyme encoded by the template nucleic acid. These methods also can be repeated or used in various combinations, e.g., to generate variations in gene/message expression, message translation or message stability. In another aspect, the genetic composition of a cell is altered by, e.g., modification of a homologous gene ex vivo, followed by its reinsertion into the cell.

A nucleic acid of the invention can be altered by any means. For example, random or stochastic methods, or, non-stochastic, or "directed evolution," methods, see, e.g., U.S. Pat. No. 6,361,974. Methods for random mutation of genes are well known in the art, see, e.g., U.S. Pat. No. 5,830,696. For example, mutagens can be used to randomly mutate a gene. Mutagens include, e.g., ultraviolet light or gamma irradiation, or a chemical mutagen, e.g., mitomycin, nitrous acid, photoactivated psoralens, alone or in combination, to induce DNA breaks amenable to repair by recombination. Other chemical mutagens include, for example, sodium bisulfite, nitrous acid, hydroxylamine, hydrazine or formic acid. Other mutagens are analogues of nucleotide precursors, e.g., nitrosoguanidine, 5-bromouracil, 2-aminopurine, or acridine. These agents can be added to a PCR reaction in place of the nucleotide precursor thereby mutating the sequence. Intercalating agents such as proflavine, acriflavine, quinacrine and the like can also be used.

Any technique in molecular biology can be used, e.g., random PCR mutagenesis, see, e.g., Rice (1992) Proc. Natl. Acad. Sci. USA 89:5467-5471; or, combinatorial multiple cassette mutagenesis, see, e.g., Crameri (1995) Biotechniques 18:194-196. Alternatively, nucleic acids, e.g., genes, can be reassembled after random, or "stochastic," fragmentation, see, e.g., U.S. Pat. Nos. 6,291,242; 6,287,862; 6,287,861; 5,955,358; 5,830,721; 5,824,514; 5,811,238; 5,605,793. In alternative aspects, modifications, additions or deletions are introduced by error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, Gene Site Saturation Mutagenesis (GSSM), synthetic ligation reassembly (SLR), recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation, Chromosomal Saturation Mutagenesis (CSM) and/or a combination of these and other methods.

The following publications describe a variety of recursive recombination procedures and/or methods which can be incorporated into the methods of the invention: Stemmer (1999) "Molecular breeding of viruses for targeting and other clinical properties" Tumor Targeting 4:1-4; Ness (1999) Nature Biotechnology 17:893-896; Chang (1999) "Evolution of a cytokine using DNA family shuffling" Nature Biotechnology 17:793-797; Minshull (1999) "Protein evolution by molecular breeding" Current Opinion in Chemical Biology 3:284-290; Christians (1999) "Directed evolution of thymidine kinase for AZT phosphorylation using DNA family shuffling" Nature Biotechnology 17:259-264; Crameri (1998) "DNA shuffling of a family of genes from diverse species accelerates directed evolution" Nature 391:288-291; Crameri (1997) "Molecular evolution of an arsenate detoxification pathway by DNA shuffling," Nature Biotechnology 15:436-438; Zhang (1997) "Directed evolution of an effective fucosidase from a galactosidase by DNA shuffling and screening" Proc. Natl. Acad. Sci. USA 94:450-44509; Patten et al. (1997) "Applications of DNA Shuffling to Pharmaceuticals and Vaccines" Current Opinion in Biotechnology 8:724-733; Crameri et al. (1996) "Construction and evolution of antibody-phage libraries by DNA shuffling" Nature Medicine 2:100-103; Gates et al. (1996) "Affinity selective isolation of ligands from peptide libraries through display on a lac repressor 'headpiece dimer'" Journal of Molecular Biology 255: 373-386; Stemmer (1996) "Sexual PCR and Assembly PCR" In: The Encyclopedia of Molecular Biology. VCH Publishers, New York. pp. 447-457; Crameri and Stemmer (1995) "Combinatorial multiple cassette mutagenesis creates all the permutations of mutant and wildtype cassettes" BioTechniques 18:194-195; Stemmer et al. (1995) "Single-step assembly of a gene and entire plasmid form large numbers of oligodeoxyribonucleotides" Gene, 164:49-53; Stemmer (1995) "The Evolution of Molecular Computation" Science 270: 1510; Stemmer (1995) "Searching Sequence Space" Bio/Technology 13:549-553; Stemmer (1994) "Rapid evolution of a protein in vitro by DNA shuffling" Nature 370:389-391; and Stemmer (1994) "DNA shuffling by random fragmentation and reassembly: In vitro recombination for molecular evolution." Proc. Natl. Acad. Sci. USA 91:10747-10751.

Mutational methods of generating diversity include, for example, site-directed mutagenesis (Ling et al. (1997) "Approaches to DNA mutagenesis: an overview" Anal Biochem. 254(2): 157-178; Dale et al. (1996) "Oligonucleotide-directed random mutagenesis using the phosphorothioate method" Methods Mol. Biol. 57:369-374; Smith (1985) "In vitro mutagenesis" Ann. Rev. Genet. 19:423-462; Botstein & Shortle (1985) "Strategies and applications of in vitro mutagenesis" Science 229:1193-1201; Carter (1986) "Site-directed mutagenesis" Biochem. J. 237:1-7; and Kunkel (1987) "The efficiency of oligonucleotide directed mutagenesis" in Nucleic Acids & Molecular Biology (Eckstein, F. and Lilley, D. M. J. eds., Springer Verlag, Berlin)); mutagenesis using uracil containing templates (Kunkel (1985) "Rapid and efficient site-specific mutagenesis without phenotypic selection" Proc. Natl. Acad. Sci. USA 82:488-492; Kunkel et al. (1987) "Rapid and efficient site-specific mutagenesis without phenotypic selection" Methods in Enzymol. 154, 367-382; and Bass et al. (1988) "Mutant Trp repressors with new DNA-binding specificities" Science 242:240-245); oligonucleotide-directed mutagenesis (Methods in Enzymol. 100: 468-500 (1983); Methods in Enzymol. 154: 329-350 (1987); Zoller (1982) "Oligonucleotide-directed mutagenesis using M13-derived vectors: an efficient and general procedure for the production of point mutations in any DNA fragment" Nucleic Acids Res. 10:6487-6500; Zoller & Smith (1983) "Oligonucleotide-directed mutagenesis of DNA fragments cloned into M13 vectors" Methods in Enzymol. 100:468-500; and Zoller (1987) Oligonucleotide-directed mutagenesis: a simple method using two oligonucleotide primers and a single-stranded DNA template" Methods in Enzymol. 154: 329-350); phosphorothioate-modified DNA mutagenesis (Taylor (1985) "The use of phosphorothioate-modified DNA in restriction enzyme reactions to prepare nicked DNA" Nucl. Acids Res. 13: 8749-8764; Taylor (1985) "The rapid generation of oligonucleotide-directed mutations at high frequency using phosphorothioate-modified DNA" Nucl. Acids Res. 13: 8765-8787 (1985); Nakamaye (1986) "Inhibition of restriction endonuclease Nci I cleavage by phosphorothioate groups and its application to oligonucleotide-directed mutagenesis" Nucl. Acids Res. 14: 9679-9698; Sayers (1988) "Y-T Exonucleases in phosphorothioate-based oligonucleotide-directed mutagenesis" Nucl. Acids Res. 16:791-802; and Sayers et al. (1988) "Strand specific cleavage of phosphorothioate-containing DNA by reaction with restriction endonucleases in the presence of ethidium bromide" Nucl. Acids Res. 16: 803-814); mutagenesis using gapped duplex DNA (Kramer et al. (1984) "The gapped duplex DNA approach to oligonucleotide-directed mutation construction" Nucl. Acids Res. 12: 9441-9456; Kramer & Fritz (1987) Methods in Enzymol. "Oligonucleotide-directed construction of mutations via gapped duplex DNA" 154:350-367; Kramer (1988) "Improved enzymatic in vitro reactions in the gapped duplex DNA approach to oligonucleotide-directed construction of mutations" Nucl. Acids Res. 16: 7207; and Fritz (1988) "Oligonucleotide-directed construction of mutations: a gapped duplex DNA procedure without enzymatic reactions in vitro" Nucl. Acids Res. 16: 6987-6999).

Additional protocols that can be used to practice the invention include point mismatch repair (Kramer (1984) "Point Mismatch Repair" Cell 38:879-887), mutagenesis using repair-deficient host strains (Carter et al. (1985) "Improved oligonucleotide site-directed mutagenesis using M13 vectors" Nucl. Acids Res. 13:4431-4443; and Carter (1987) "Improved oligonucleotide-directed mutagenesis using M13 vectors" Methods in Enzymol. 154: 382-403), deletion mutagenesis (Eghtedarzadeh (1986) "Use of oligonucleotides to generate large deletions" Nucl. Acids Res. 14: 5115), restriction-selection and restriction-selection and restriction-purification (Wells et al. (1986) "Importance of hydrogen-bond formation in stabilizing the transition state of subtilisin" Phil. Trans. R. Soc. Lond. A 317: 415-423), mutagenesis by total gene synthesis (Nambiar et al. (1984) "Total synthesis and cloning of a gene coding for the ribonuclease S protein" Science 223: 1299-1301; Sakamar and Khorana (1988) "Total synthesis and expression of a gene for the a-subunit of bovine rod outer segment guanine nucleotide-binding protein (transducin)" Nucl. Acids Res. 14: 6361-6372; Wells et al. (1985) "Cassette mutagenesis: an efficient method for generation of multiple mutations at defined sites" Gene 34:315-323; and Grundstrom et al. (1985) "Oligonucleotide-directed mutagenesis by microscale 'shotgun' gene synthesis" Nucl. Acids Res. 13: 3305-3316), double-strand break repair (Mandecki (1986); Arnold (1993) "Protein engineering for unusual environments" Current Opinion in Biotechnology 4:450-455. "Oligonucleotide-directed double-strand break repair in plasmids of Escherichia coli: a method for site-specific mutagenesis" Proc. Natl. Acad. Sci. USA, 83:7177-7181). Additional details on many of the above methods can be found in Methods in Enzymology Volume 154, which also describes useful controls for trouble-shooting problems with various mutagenesis methods.

Protocols that can be used to practice the invention are described, e.g., in U.S. Pat. No. 5,605,793 to Stemmer (Feb. 25, 1997), "Methods for In Vitro Recombination;" U.S. Pat. No. 5,811,238 to Stemmer et al. (Sep. 22, 1998) "Methods for Generating Polynucleotides having Desired Characteristics by Iterative Selection and Recombination;" U.S. Pat. No. 5,830,721 to Stemmer et al. (Nov. 3, 1998), "DNA Mutagenesis by Random Fragmentation and Reassembly;" U.S. Pat. No. 5,834,252 to Stemmer, et al. (Nov. 10, 1998) "End-Complementary Polymerase Reaction;" U.S. Pat. No. 5,837,458 to Minshull, et al. (Nov. 17, 1998), "Methods and Compositions for Cellular and Metabolic Engineering;" WO 95/22625, Stemmer and Crameri, "Mutagenesis by Random Fragmentation and Reassembly;" WO 96/33207 by Stemmer and Lipschutz "End Complementary Polymerase Chain Reaction;" WO 97/20078 by Stemmer and Crameri "Methods for Generating Polynucleotides having Desired Characteristics by Iterative Selection and Recombination;" WO 97/35966 by Minshull and Stemmer, "Methods and Compositions for Cellular and Metabolic Engineering;" WO 99/41402 by Punnonen et al. "Targeting of Genetic Vaccine Vectors;" WO 99/41383 by Punnonen et al. "Antigen Library Immunization;" WO 99/41369 by Punnonen et al. "Genetic Vaccine Vector Engineering;" WO 99/41368 by Punnonen et al. "Optimization of Immunomodulatory Properties of Genetic Vaccines;" EP 752008 by Stemmer and Crameri, "DNA Mutagenesis by Random Fragmentation and Reassembly;" EP 0932670 by Stemmer "Evolving Cellular DNA Uptake by Recursive Sequence Recombination;" WO 99/23107 by Stemmer et al., "Modification of Virus Tropism and Host Range by Viral Genome Shuffling;" WO 99/21979 by Apt et al., "Human Papillomavirus Vectors;" WO 98/31837 by del Cardayre et al. "Evolution of Whole Cells and Organisms by Recursive Sequence Recombination;" WO 98/27230 by Patten and Stemmer, "Methods and Compositions for Polypeptide Engineering;" WO 98/27230 by Stemmer et al., "Methods for Optimization of Gene Therapy by Recursive Sequence Shuffling and Selection," WO 00/00632, "Methods for Generating Highly Diverse Libraries," WO 00/09679, "Methods for Obtaining in Vitro Recombined Polynucleotide Sequence Banks and Resulting Sequences," WO 98/42832 by Arnold et al., "Recombination of Polynucleotide Sequences Using Random or Defined Primers," WO 99/29902 by Arnold et al., "Method for Creating Polynucleotide and Polypeptide Sequences," WO 98/41653 by Vind, "An in Vitro Method for Construction of a DNA Library," WO 98/41622 by Borchert et al., "Method for Constructing a Library Using DNA Shuffling," and WO 98/42727 by Pati and Zarling, "Sequence Alterations using Homologous Recombination."

Protocols that can be used to practice the invention (providing details regarding various diversity generating methods) are described, e.g., in U.S. patent application Ser. No. 09/407,800, "SHUFFLING OF CODON ALTERED GENES" by Patten et al. filed Sep. 28, 1999; "EVOLUTION OF WHOLE CELLS AND ORGANISMS BY RECURSIVE SEQUENCE RECOMBINATION" by del Cardayre et al., U.S. Pat. No. 6,379,964; "OLIGONUCLEOTIDE MEDIATED NUCLEIC ACID RECOMBINATION" by Crameri et al., U.S. Pat. Nos. 6,319,714; 6,368,861; 6,376,246; 6,423, 542; 6,426,224 and PCT/US00/01203; "USE OF CODON-VARIED OLIGONUCLEOTIDE SYNTHESIS FOR SYNTHETIC SHUFFLING" by Welch et al., U.S. Pat. No. 6,436,675; "METHODS FOR MAKING CHARACTER STRINGS, POLYNUCLEOTIDES & POLYPEPTIDES HAVING DESIRED CHARACTERISTICS" by Selifonov et al., filed Jan. 18, 2000, (PCT/US00/01202) and, e.g. "METHODS FOR MAKING CHARACTER STRINGS, POLYNUCLEOTIDES & POLYPEPTIDES HAVING DESIRED CHARACTERISTICS" by Selifonov et al., filed Jul. 18, 2000 (U.S. Ser. No. 09/618,579); "METHODS OF POPULATING DATA STRUCTURES FOR USE IN EVOLUTIONARY SIMULATIONS" by Selifonov and Stemmer, filed Jan. 18, 2000 (PCT/US00/01138); and "SINGLE-STRANDED NUCLEIC ACID TEMPLATE-MEDIATED RECOMBINATION AND NUCLEIC ACID FRAGMENT ISOLATION" by Affholter, filed Sep. 6, 2000 (U.S. Ser. No. 09/656,549); and U.S. Pat. Nos. 6,177,263; 6,153,410.

Non-stochastic, or "directed evolution," methods include, e.g., saturation mutagenesis, such as Gene Site Saturation Mutagenesis (GSSM), synthetic ligation reassembly (SLR), or a combination thereof are used to modify the nucleic acids of the invention to generate cellulase, e.g., endoglucanase, cellobiohydrolase, beta-glucosidase, xylanase, mannanse, β-xylosidase, arabinofuranosidase, and/or oligomerase enzymes with new or altered properties (e.g., activity under highly acidic or alkaline conditions, high or low temperatures, and the like). Polypeptides encoded by the modified nucleic acids can be screened for an activity before testing for glucan hydrolysis or other activity. Any testing modality or protocol can be used, e.g., using a capillary array platform. See, e.g., U.S. Pat. Nos. 6,361,974; 6,280,926; 5,939,250.

Gene Site Saturation Mutagenesis, or, GSSM

Figure 11:
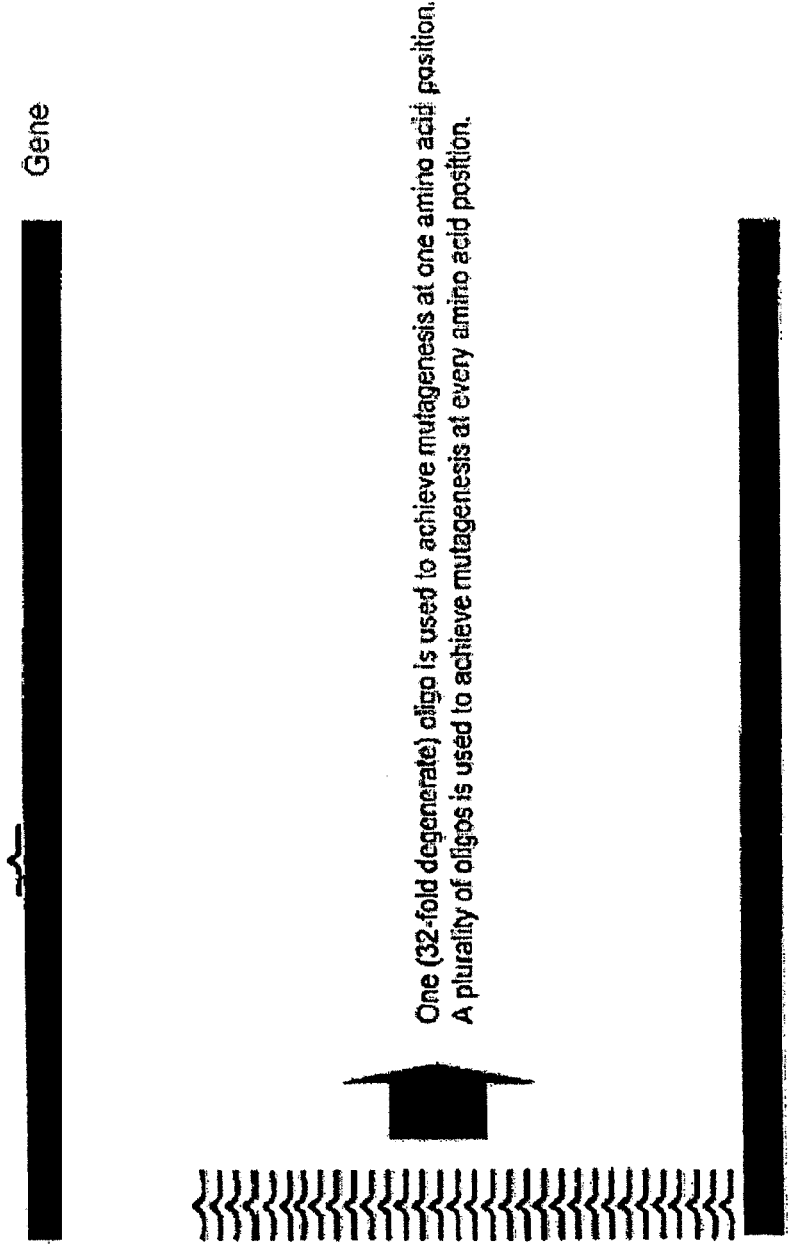
FIG. 11 is a diagram illustrating the use of a gene site-saturation mutagenesis (GSSM) approach for achieving all possible amino acid changes at each amino acid site along the polypeptide.
Figure 12:
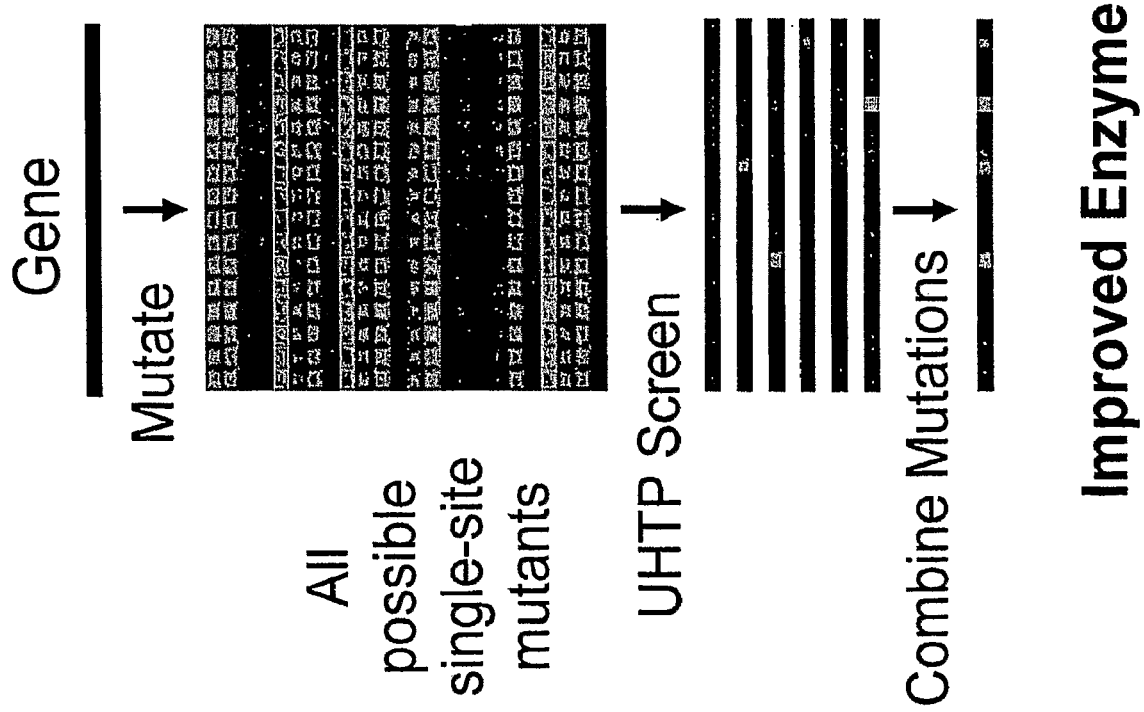
FIG. 12 is an overview of the GSSM process.
Figure 13:
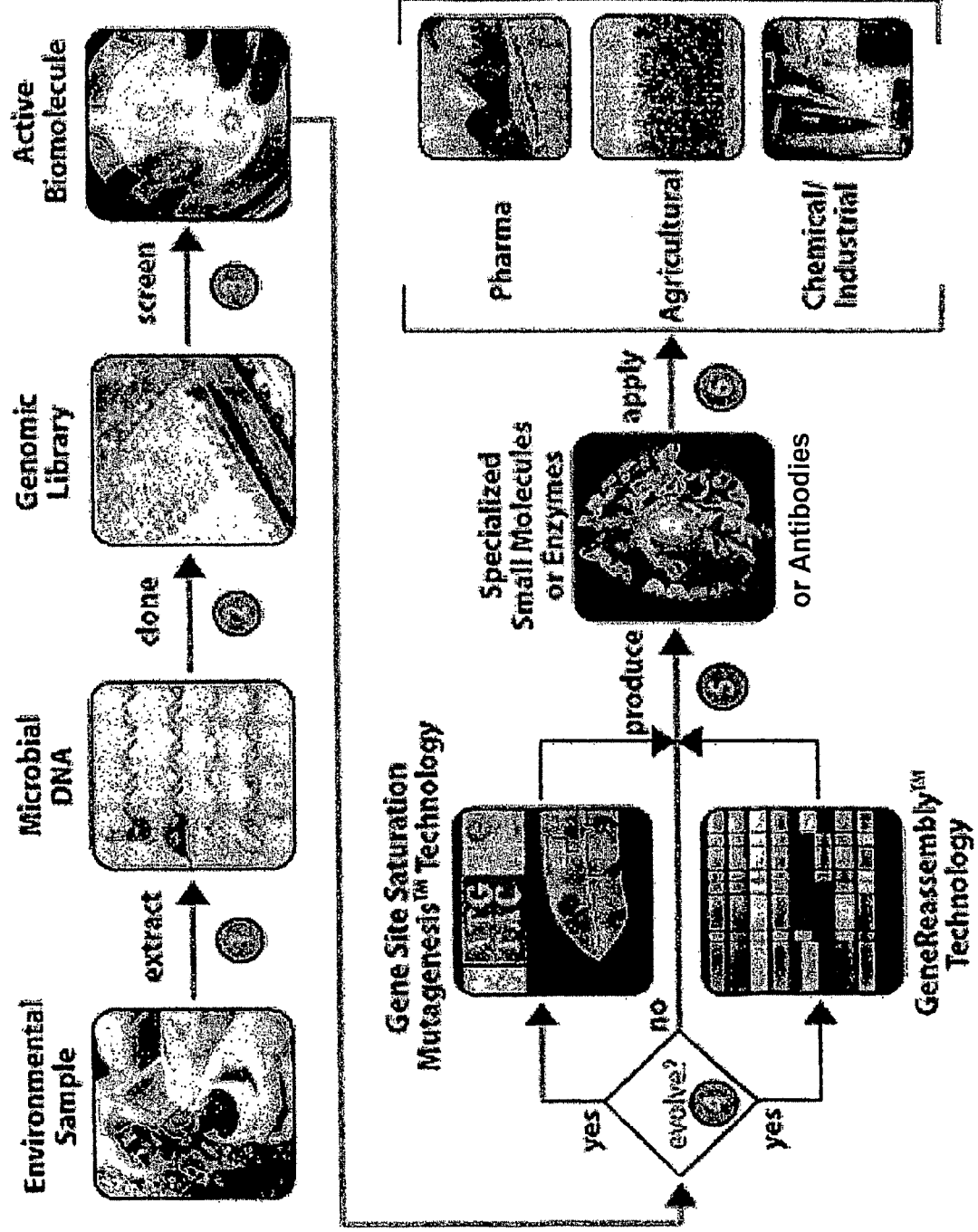
FIG. 13 is an overview of the Gene Discovery & DIRECT-EVOLUTION® Technology (Diversa Corporation, San Diego, Calif.) used to develop and practice the invention, as described herein.
Figure 15:
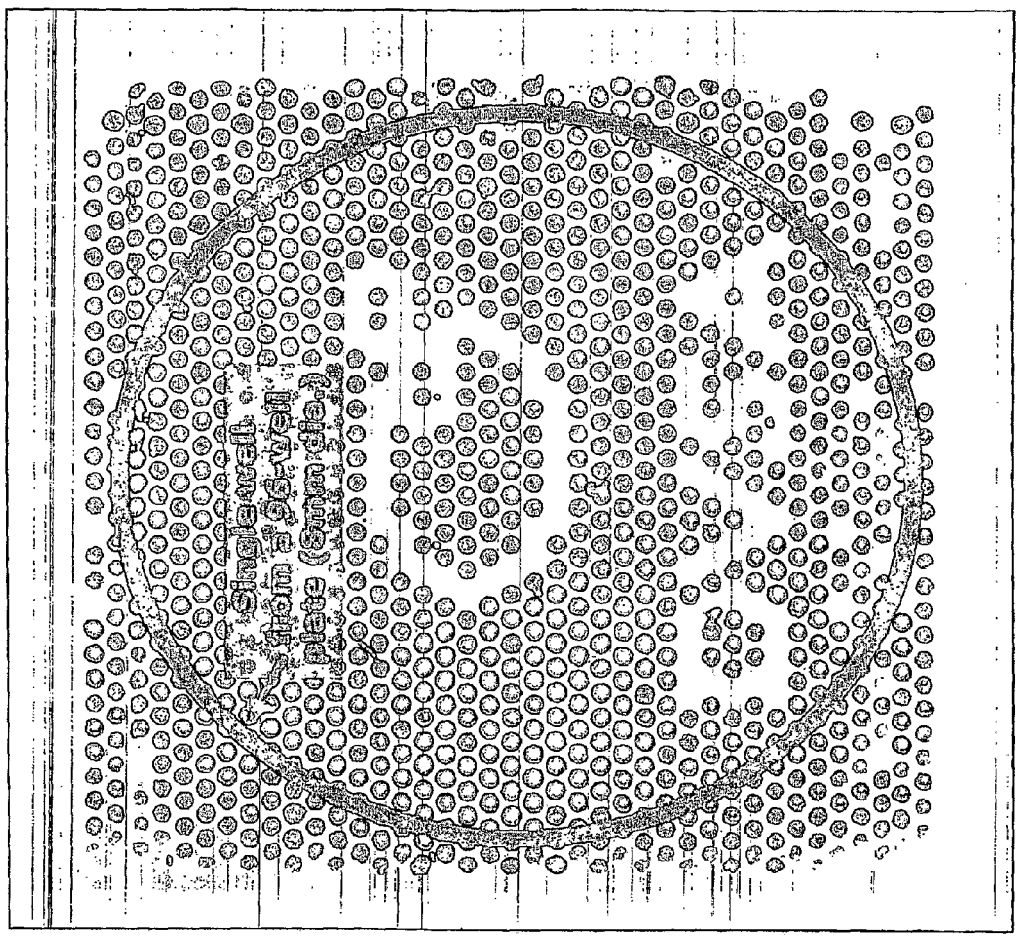
FIG. 15 illustrates the size of a single well from a 96-well plate (8 mm diameter (dia.)) compared to approx. 1,000 GIGMARIX™ wells (approx. 0.2 mm dia.)

The invention also provides methods for making enzyme using Gene Site Saturation mutagenesis, or, GSSM, as described herein, and also in U.S. Pat. Nos. 6,171,820 and 6,579,258. FIG. 11 is a diagram illustrating the use of a gene site-saturation mutagenesis (GSSM) approach for achieving all possible amino acid changes at each amino acid site along the polypeptide. The oligos used are comprised of a homologous sequence, a triplet sequence composed of degenerate N,N, G/T, and another homologous sequence. Thus, the degeneracy of each oligo is derived from the degeneracy of the N,N, G/T cassette contained therein. The resultant polymerization products from the use of such oligos include all possible amino acid changes at each amino acid site along the polypeptide, because the N,N, G/T sequence is able to code for all 20 amino acids. As shown, a separate degenerate oligo is used for mutagenizing each codon in a polynucleotide encoding a polypeptide.

In one aspect, codon primers containing a degenerate N,N, G/T sequence are used to introduce point mutations into a polynucleotide, e.g., a cellulase, e.g., endoglucanase, cellobiohydrolase, beta-glucosidase, xylanase, mannanse, β-xylosidase, arabinofuranosidase, and/or oligomerase enzyme or an antibody of the invention, so as to generate a set of progeny polypeptides in which a full range of single amino acid substitutions is represented at each amino acid position, e.g., an amino acid residue in an enzyme active site or ligand binding site targeted to be modified. These oligonucleotides can comprise a contiguous first homologous sequence, a degenerate N,N,G/T sequence, and, optionally, a second homologous sequence. The downstream progeny translational products from the use of such oligonucleotides include all possible amino acid changes at each amino acid site along the polypeptide, because the degeneracy of the N,N,G/T sequence includes codons for all 20 amino acids. In one aspect, one such degenerate oligonucleotide (comprised of, e.g., one degenerate N,N,G/T cassette) is used for subjecting each original codon in a parental polynucleotide template to a full range of codon substitutions. In another aspect, at least two degenerate cassettes are used—either in the same oligonucleotide or not, for subjecting at least two original codons in a parental polynucleotide template to a full range of codon substitutions. For example, more than one N,N,G/T sequence can be contained in one oligonucleotide to introduce amino acid mutations at more than one site. This plurality of N,N, G/T sequences can be directly contiguous, or separated by one or more additional nucleotide sequence(s). In another aspect, oligonucleotides serviceable for introducing additions and deletions can be used either alone or in combination with the codons containing an N,N,G/T sequence, to introduce any combination or permutation of amino acid additions, deletions, and/or substitutions.

In one aspect, simultaneous mutagenesis of two or more contiguous amino acid positions is done using an oligonucleotide that contains contiguous N,N,G/T triplets, i.e. a degenerate (N,N,G/T)n sequence. In another aspect, degenerate cassettes having less degeneracy than the N,N,G/T sequence are used. For example, it may be desirable in some instances to use (e.g. in an oligonucleotide) a degenerate triplet sequence comprised of only one N, where said N can be in the first second or third position of the triplet. Any other bases including any combinations and permutations thereof can be used in the remaining two positions of the triplet. Alternatively, it may be desirable in some instances to use (e.g. in an oligo) a degenerate N,N,N triplet sequence.

In one aspect, use of degenerate triplets (e.g., N,N,G/T triplets) allows for systematic and easy generation of a full range of possible natural amino acids (for a total of 20 amino acids) into each and every amino acid position in a polypeptide (in alternative aspects, the methods also include generation of less than all possible substitutions per amino acid residue, or codon, position). For example, for a 100 amino acid polypeptide, 2000 distinct species (i.e. 20 possible amino acids per position X 100 amino acid positions) can be generated. Through the use of an oligonucleotide or set of oligonucleotides containing a 10 degenerate N,N,G/T triplet, 32 individual sequences can code for all 20 possible natural amino acids. Thus, in a reaction vessel in which a parental polynucleotide sequence is subjected to saturation mutagenesis using at least one such oligonucleotide, there are generated 32 distinct progeny polynucleotides encoding 20 distinct polypeptides. In contrast, the use of a non-degenerate oligonucleotide in site-directed mutagenesis leads to only one progeny polypeptide product per reaction vessel. Nondegenerate oligonucleotides can optionally be used in combination with degenerate primers disclosed; for example, nondegenerate oligonucleotides can be used to generate specific point mutations in a working polynucleotide. This provides one means to generate specific silent point mutations, point mutations leading to corresponding amino acid changes, and point mutations that cause the generation of stop codons and the corresponding expression of polypeptide fragments.

In one aspect, each saturation mutagenesis reaction vessel contains polynucleotides encoding at least 20 progeny polypeptide (e.g., cellulase, e.g., endoglucanase, cellobiohydrolase, beta-glucosidase, xylanase, mannanse, β-xylosidase, arabinofuranosidase, and/or oligomerase enzymes) molecules such that all 20 natural amino acids are represented at the one specific amino acid position corresponding to the codon position mutagenized in the parental polynucleotide (other aspects use less than all 20 natural combinations). The 32-fold degenerate progeny polypeptides generated from each saturation mutagenesis reaction vessel can be subjected to clonal amplification (e.g. cloned into a suitable host, e.g., *E. coli* host, using, e.g., an expression vector) and subjected to expression screening. When an individual progeny polypeptide is identified by screening to display a favorable change in property (when compared to the parental polypeptide, such as increased glucan hydrolysis activity under alkaline or acidic conditions), it can be sequenced to identify the correspondingly favorable amino acid substitution contained therein.

In one aspect, upon mutagenizing each and every amino acid position in a parental polypeptide using saturation mutagenesis as disclosed herein, favorable amino acid changes may be identified at more than one amino acid position. One or more new progeny molecules can be generated that contain a combination of all or part of these favorable amino acid substitutions. For example, if 2 specific favorable amino acid changes are identified in each of 3 amino acid positions in a polypeptide, the permutations include 3 possibilities at each position (no change from the original amino acid, and each of two favorable changes) and 3 positions. Thus, there are 3×3×3 or 27 total possibilities, including 7 that were previously examined—6 single point mutations (i.e. 2 at each of three positions) and no change at any position.

In yet another aspect, site-saturation mutagenesis can be used together with shuffling, chimerization, recombination and other mutagenizing processes, along with screening. This invention provides for the use of any mutagenizing process (es), including saturation mutagenesis, in an iterative manner. In one exemplification, the iterative use of any mutagenizing process(es) is used in combination with screening.

The invention also provides for the use of proprietary codon primers (containing a degenerate N,N,N sequence) to introduce point mutations into a polynucleotide, so as to generate a set of progeny polypeptides in which a full range of single amino acid substitutions is represented at each amino acid position (Gene Site Saturation Mutagenesis (GSSM)). The oligos used are comprised contiguously of a first homologous sequence, a degenerate N,N,N sequence and in one aspect but not necessarily a second homologous sequence. The downstream progeny translational products from the use of such oligos include all possible amino acid changes at each amino acid site along the polypeptide, because the degeneracy of the N,N,N sequence includes codons for all 20 amino acids.

In one aspect, one such degenerate oligo (comprised of one degenerate N,N,N cassette) is used for subjecting each original codon in a parental polynucleotide template to a full range of codon substitutions. In another aspect, at least two degenerate N,N,N cassettes are used—either in the same oligo or not, for subjecting at least two original codons in a parental polynucleotide template to a full range of codon substitutions. Thus, more than one N,N,N sequence can be contained in one oligo to introduce amino acid mutations at more than one site. This plurality of N,N,N sequences can be directly contiguous, or separated by one or more additional nucleotide sequence(s). In another aspect, oligos serviceable for introducing additions and deletions can be used either alone or in combination with the codons containing an N,N,N sequence, to introduce any combination or permutation of amino acid additions, deletions and/or substitutions.

In one aspect, it is possible to simultaneously mutagenize two or more contiguous amino acid positions using an oligo that contains contiguous N,N,N triplets, i.e. a degenerate $(N,N,N)_n$ sequence. In another aspect, the present invention provides for the use of degenerate cassettes having less degeneracy than the N,N,N sequence. For example, it may be desirable in some instances to use (e.g. in an oligo) a degenerate triplet sequence comprised of only one N, where the N can be in the first second or third position of the triplet. Any other bases including any combinations and permutations thereof can be used in the remaining two positions of the triplet. Alternatively, it may be desirable in some instances to use (e.g., in an oligo) a degenerate N,N,N triplet sequence, N,N,G/T, or an N,N, G/C triplet sequence.

In one aspect, use of a degenerate triplet (such as N,N,G/T or an N,N, G/C triplet sequence) is advantageous for several reasons. In one aspect, this invention provides a means to systematically and fairly easily generate the substitution of the full range of possible amino acids (for a total of 20 amino acids) into each and every amino acid position in a polypeptide. Thus, for a 100 amino acid polypeptide, the invention provides a way to systematically and fairly easily generate 2000 distinct species (i.e., 20 possible amino acids per position times 100 amino acid positions). It is appreciated that there is provided, through the use of an oligo containing a degenerate N,N,G/T or an N,N, G/C triplet sequence, 32 individual sequences that code for 20 possible amino acids. Thus, in a reaction vessel in which a parental polynucleotide sequence is subjected to saturation mutagenesis using one such oligo, there are generated 32 distinct progeny polynucleotides encoding 20 distinct polypeptides. In contrast, the use of a non-degenerate oligo in site-directed mutagenesis leads to only one progeny polypeptide product per reaction vessel.

This invention also provides for the use of nondegenerate oligos, which can optionally be used in combination with degenerate primers disclosed. It is appreciated that in some situations, it is advantageous to use nondegenerate oligos to generate specific point mutations in a working polynucleotide. This provides a means to generate specific silent point mutations, point mutations leading to corresponding amino acid changes and point mutations that cause the generation of stop codons and the corresponding expression of polypeptide fragments.

Thus, in one aspect of this invention, each saturation mutagenesis reaction vessel contains polynucleotides encoding at least 20 progeny polypeptide molecules such that all 20 amino acids are represented at the one specific amino acid position corresponding to the codon position mutagenized in the parental polynucleotide. The 32-fold degenerate progeny polypeptides generated from each saturation mutagenesis reaction vessel can be subjected to clonal amplification (e.g., cloned into a suitable *E. coli* host using an expression vector) and subjected to expression screening. When an individual progeny polypeptide is identified by screening to display a favorable change in property (when compared to the parental polypeptide), it can be sequenced to identify the correspondingly favorable amino acid substitution contained therein.

In one aspect, upon mutagenizing each and every amino acid position in a parental polypeptide using saturation mutagenesis as disclosed herein, a favorable amino acid changes is identified at more than one amino acid position. One or more new progeny molecules can be generated that contain a combination of all or part of these favorable amino acid substitutions. For example, if 2 specific favorable amino acid changes are identified in each of 3 amino acid positions in a polypeptide, the permutations include 3 possibilities at each position (no change from the original amino acid and each of two favorable changes) and 3 positions. Thus, there are 3×3×3 or 27 total possibilities, including 7 that were previously examined—6 single point mutations (i.e., 2 at each of three positions) and no change at any position.

The invention provides for the use of saturation mutagenesis in combination with additional mutagenization processes, such as process where two or more related polynucleotides are introduced into a suitable host cell such that a hybrid polynucleotide is generated by recombination and reductive reassortment.

In addition to performing mutagenesis along the entire sequence of a gene, the instant invention provides that mutagenesis can be use to replace each of any number of bases in a polynucleotide sequence, wherein the number of bases to be mutagenized is in one aspect every integer from 15 to 100,000. Thus, instead of mutagenizing every position along a molecule, one can subject every or a discrete number of bases (in one aspect a subset totaling from 15 to 100,000) to mutagenesis. In one aspect, a separate nucleotide is used for mutagenizing each position or group of positions along a polynucleotide sequence. A group of 3 positions to be mutagenized may be a codon. The mutations can be introduced using a mutagenic primer, containing a heterologous cassette, also referred to as a mutagenic cassette. Exemplary cassettes can have from 1 to 500 bases. Each nucleotide position in such heterologous cassettes be N, A, C, G, T, A/C, A/G, A/T, C/G, C/T, G/T, C/G/T, A/G/T, A/C/T, A/C/G, or E, where E is any base that is not A, C, G, or T (E can be referred to as a designer oligo).

In one aspect, saturation mutagenesis is comprised of mutagenizing a complete set of mutagenic cassettes (wherein each cassette is in one aspect about 1-500 bases in length) in defined polynucleotide sequence to be mutagenized (wherein the sequence to be mutagenized is in one aspect from about 15 to 100,000 bases in length). Thus, a group of mutations (ranging from 1 to 100 mutations) is introduced into each cassette to be mutagenized. A grouping of mutations to be introduced into one cassette can be different or the same from a second grouping of mutations to be introduced into a second cassette during the application of one round of saturation mutagenesis. Such groupings are exemplified by deletions, additions, groupings of particular codons and groupings of particular nucleotide cassettes.

In one aspect, defined sequences to be mutagenized include a whole gene, pathway, cDNA, an entire open reading frame (ORF) and entire promoter, enhancer, repressor/transactivator, origin of replication, intron, operator, or any polynucleotide functional group. Generally, a "defined sequences" for this purpose may be any polynucleotide that a 15 base-polynucleotide sequence and polynucleotide sequences of lengths between 15 bases and 15,000 bases (this invention specifically names every integer in between). Considerations in choosing groupings of codons include types of amino acids encoded by a degenerate mutagenic cassette.

In one aspect, a grouping of mutations that can be introduced into a mutagenic cassette, this invention specifically provides for degenerate codon substitutions (using degenerate oligos) that code for 2, 3, 4, 5, 6, 7, 8, 9, 10, 11, 12, 13, 14, 15, 16, 17, 18, 19 and 20 amino acids at each position and a library of polypeptides encoded thereby.

Synthetic Ligation Reassembly (SLR)

The invention provides a non-stochastic gene modification system termed "synthetic ligation reassembly," or simply "SLR," a "directed evolution process," to generate polypeptides, e.g., cellulase, e.g., endoglucanase, cellobiohydrolase, beta-glucosidase, xylanase, mannanse, β-xylosidase, arabinofuranosidase, and/or oligomerase enzymes or antibodies of the invention, with new or altered properties.

SLR is a method of ligating oligonucleotide fragments together non-stochastically. This method differs from stochastic oligonucleotide shuffling in that the nucleic acid building blocks are not shuffled, concatenated or chimerized randomly, but rather are assembled non-stochastically. See, e.g., U.S. Pat. Nos. 6,773,900; 6,740,506; 6,713,282; 6,635,449; 6,605,449; 6,537,776. In one aspect, SLR comprises the following steps: (a) providing a template polynucleotide, wherein the template polynucleotide comprises sequence encoding a homologous gene; (b) providing a plurality of building block polynucleotides, wherein the building block polynucleotides are designed to cross-over reassemble with the template polynucleotide at a predetermined sequence, and a building block polynucleotide comprises a sequence that is a variant of the homologous gene and a sequence homologous to the template polynucleotide flanking the variant sequence; (c) combining a building block polynucleotide with a template polynucleotide such that the building block polynucleotide cross-over reassembles with the template polynucleotide to generate polynucleotides comprising homologous gene sequence variations.

SLR does not depend on the presence of high levels of homology between polynucleotides to be rearranged. Thus, this method can be used to non-stochastically generate libraries (or sets) of progeny molecules comprised of over $10^{100}$ different chimeras. SLR can be used to generate libraries comprised of over $10^{1000}$ different progeny chimeras. Thus, aspects of the present invention include non-stochastic methods of producing a set of finalized chimeric nucleic acid molecule shaving an overall assembly order that is chosen by design. This method includes the steps of generating by design a plurality of specific nucleic acid building blocks having serviceable mutually compatible ligatable ends, and assembling these nucleic acid building blocks, such that a designed overall assembly order is achieved.

The mutually compatible ligatable ends of the nucleic acid building blocks to be assembled are considered to be "serviceable" for this type of ordered assembly if they enable the building blocks to be coupled in predetermined orders. Thus, the overall assembly order in which the nucleic acid building blocks can be coupled is specified by the design of the ligatable ends. If more than one assembly step is to be used, then the overall assembly order in which the nucleic acid building blocks can be coupled is also specified by the sequential order of the assembly step(s). In one aspect, the annealed building pieces are treated with an enzyme, such as a ligase (e.g. T4 DNA ligase), to achieve covalent bonding of the building pieces.

In one aspect, the design of the oligonucleotide building blocks is obtained by analyzing a set of progenitor nucleic acid sequence templates that serve as a basis for producing a progeny set of finalized chimeric polynucleotides. These parental oligonucleotide templates thus serve as a source of sequence information that aids in the design of the nucleic acid building blocks that are to be mutagenized, e.g., chimerized or shuffled. In one aspect of this method, the sequences of a plurality of parental nucleic acid templates are aligned in order to select one or more demarcation points. The demarcation points can be located at an area of homology, and are comprised of one or more nucleotides. These demarcation points are in one aspect shared by at least two of the progenitor templates. The demarcation points can thereby be used to delineate the boundaries of oligonucleotide building blocks to be generated in order to rearrange the parental polynucleotides. The demarcation points identified and selected in the progenitor molecules serve as potential chimerization points in the assembly of the final chimeric progeny molecules. A demarcation point can be an area of homology (comprised of at least one homologous nucleotide base) shared by at least two parental polynucleotide sequences. Alternatively, a demarcation point can be an area of homology that is shared by at least half of the parental polynucleotide sequences, or, it can be an area of homology that is shared by at least two thirds of the parental polynucleotide sequences. Even more in one aspect a serviceable demarcation points is an area of homology that is shared by at least three fourths of the parental polynucleotide sequences, or, it can be shared by at almost all of the parental polynucleotide sequences. In one aspect, a demarcation point is an area of homology that is shared by all of the parental polynucleotide sequences.

In one aspect, a ligation reassembly process is performed exhaustively in order to generate an exhaustive library of progeny chimeric polynucleotides. In other words, all possible ordered combinations of the nucleic acid building blocks are represented in the set of finalized chimeric nucleic acid molecules. At the same time, in another aspect, the assembly order (i.e. the order of assembly of each building block in the 5' to 3 sequence of each finalized chimeric nucleic acid) in each combination is by design (or non-stochastic) as described above. Because of the non-stochastic nature of this invention, the possibility of unwanted side products is greatly reduced.

In another aspect, the ligation reassembly method is performed systematically. For example, the method is performed in order to generate a systematically compartmentalized library of progeny molecules, with compartments that can be screened systematically, e.g. one by one. In other words this invention provides that, through the selective and judicious use of specific nucleic acid building blocks, coupled with the selective and judicious use of sequentially stepped assembly reactions, a design can be achieved where specific sets of progeny products are made in each of several reaction vessels. This allows a systematic examination and screening procedure to be performed. Thus, these methods allow a potentially very large number of progeny molecules to be examined systematically in smaller groups. Because of its ability to perform chimerizations in a manner that is highly flexible yet exhaustive and systematic as well, particularly when there is a low level of homology among the progenitor molecules, these methods provide for the generation of a library (or set) comprised of a large number of progeny molecules. Because of the non-stochastic nature of the instant ligation reassembly invention, the progeny molecules generated in one aspect comprise a library of finalized chimeric nucleic acid molecules having an overall assembly order that is chosen by design. The saturation mutagenesis and optimized directed evolution methods also can be used to generate different progeny molecular species. It is appreciated that the invention provides freedom of choice and control regarding the selection of demarcation points, the size and number of the nucleic acid building blocks, and the size and design of the couplings. It is appreciated, furthermore, that the requirement for intermolecular homology is highly relaxed for the operability of this invention. In fact, demarcation points can even be chosen in areas of little or no intermolecular homology. For example, because of codon wobble, i.e. the degeneracy of codons, nucleotide substitutions can be introduced into nucleic acid building blocks without altering the amino acid originally encoded in the corresponding progenitor template. Alternatively, a codon can be altered such that the coding for an originally amino acid is altered. This invention provides that such substitutions can be introduced into the nucleic acid building block in order to increase the incidence of intermolecular homologous demarcation points and thus to allow an increased number of couplings to be achieved among the building blocks, which in turn allows a greater number of progeny chimeric molecules to be generated.

Synthetic Gene Reassembly

In one aspect, the present invention provides a non-stochastic method termed synthetic gene reassembly, that is somewhat related to stochastic shuffling, save that the nucleic acid building blocks are not shuffled or concatenated or chimerized randomly, but rather are assembled non-stochastically. See, e.g., U.S. Pat. No. 6,537,776.

The synthetic gene reassembly method does not depend on the presence of a high level of homology between polynucleotides to be shuffled. The invention can be used to non-stochastically generate libraries (or sets) of progeny molecules comprised of over $10^{100}$ different chimeras. Conceivably, synthetic gene reassembly can even be used to generate libraries comprised of over $10^{1000}$ different progeny chimeras.

Thus, in one aspect, the invention provides a non-stochastic method of producing a set of finalized chimeric nucleic acid molecules having an overall assembly order that is chosen by design, which method is comprised of the steps of generating by design a plurality of specific nucleic acid building blocks having serviceable mutually compatible ligatable ends and assembling these nucleic acid building blocks, such that a designed overall assembly order is achieved.

The mutually compatible ligatable ends of the nucleic acid building blocks to be assembled are considered to be "serviceable" for this type of ordered assembly if they enable the building blocks to be coupled in predetermined orders. Thus, in one aspect, the overall assembly order in which the nucleic acid building blocks can be coupled is specified by the design of the ligatable ends and, if more than one assembly step is to be used, then the overall assembly order in which the nucleic acid building blocks can be coupled is also specified by the sequential order of the assembly step(s). In a one aspect of the invention, the annealed building pieces are treated with an enzyme, such as a ligase (e.g., T4 DNA ligase) to achieve covalent bonding of the building pieces.

In a another aspect, the design of nucleic acid building blocks is obtained upon analysis of the sequences of a set of progenitor nucleic acid templates that serve as a basis for producing a progeny set of finalized chimeric nucleic acid molecules. These progenitor nucleic acid templates thus serve as a source of sequence information that aids in the design of the nucleic acid building blocks that are to be mutagenized, i.e. chimerized or shuffled.

In one exemplification, the invention provides for the chimerization of a family of related genes and their encoded family of related products. In a particular exemplification, the encoded products are enzymes. The cellulase, e.g., endoglucanase, cellobiohydrolase, beta-glucosidase, xylanase, mannanse, β-xylosidase, arabinofuranosidase, and/or oligomerase enzymes of the present invention can be mutagenized in accordance with the methods described herein.

Thus according to one aspect of the invention, the sequences of a plurality of progenitor nucleic acid templates (e.g., polynucleotides of the invention) are aligned in order to select one or more demarcation points, which demarcation points can be located at an area of homology. The demarcation points can be used to delineate the boundaries of nucleic acid building blocks to be generated. Thus, the demarcation points identified and selected in the progenitor molecules serve as potential chimerization points in the assembly of the progeny molecules.

In one aspect, a serviceable demarcation point is an area of homology (comprised of at least one homologous nucleotide base) shared by at least two progenitor templates, but the demarcation point can be an area of homology that is shared by at least half of the progenitor templates, at least two thirds of the progenitor templates, at least three fourths of the progenitor templates and in one aspect at almost all of the progenitor templates. Even more in one aspect still a serviceable demarcation point is an area of homology that is shared by all of the progenitor templates.

In a one aspect, the gene reassembly process is performed exhaustively in order to generate an exhaustive library. In other words, all possible ordered combinations of the nucleic acid building blocks are represented in the set of finalized chimeric nucleic acid molecules. At the same time, the assembly order (i.e. the order of assembly of each building block in the 5' to 3 sequence of each finalized chimeric nucleic acid) in each combination is by design (or non-stochastic). Because of the non-stochastic nature of the method, the possibility of unwanted side products is greatly reduced.

In another aspect, the method provides that the gene reassembly process is performed systematically, for example to generate a systematically compartmentalized library, with compartments that can be screened systematically, e.g., one by one. In other words the invention provides that, through the selective and judicious use of specific nucleic acid building blocks, coupled with the selective and judicious use of sequentially stepped assembly reactions, an experimental design can be achieved where specific sets of progeny products are made in each of several reaction vessels. This allows a systematic examination and screening procedure to be performed. Thus, it allows a potentially very large number of progeny molecules to be examined systematically in smaller groups.

Because of its ability to perform chimerizations in a manner that is highly flexible yet exhaustive and systematic as well, particularly when there is a low level of homology among the progenitor molecules, the instant invention provides for the generation of a library (or set) comprised of a large number of progeny molecules. Because of the non-stochastic nature of the instant gene reassembly invention, the progeny molecules generated in one aspect comprise a library of finalized chimeric nucleic acid molecules having an overall assembly order that is chosen by design. In a particularly aspect, such a generated library is comprised of greater than $10^3$ to greater than $10^{1000}$ different progeny molecular species.

In one aspect, a set of finalized chimeric nucleic acid molecules, produced as described is comprised of a polynucleotide encoding a polypeptide. According to one aspect, this polynucleotide is a gene, which may be a man-made gene. According to another aspect, this polynucleotide is a gene pathway, which may be a man-made gene pathway. The invention provides that one or more man-made genes generated by the invention may be incorporated into a man-made gene pathway, such as pathway operable in a eukaryotic organism (including a plant).

In another exemplification, the synthetic nature of the step in which the building blocks are generated allows the design and introduction of nucleotides (e.g. one or more nucleotides, which may be, for example, codons or introns or regulatory sequences) that can later be optionally removed in an in vitro process (e.g., by mutagenesis) or in an in vivo process (e.g., by utilizing the gene splicing ability of a host organism). It is appreciated that in many instances the introduction of these nucleotides may also be desirable for many other reasons in addition to the potential benefit of creating a serviceable demarcation point.

Thus, according to another aspect, the invention provides that a nucleic acid building block can be used to introduce an intron. Thus, the invention provides that functional introns may be introduced into a man-made gene of the invention. The invention also provides that functional introns may be introduced into a man-made gene pathway of the invention. Accordingly, the invention provides for the generation of a chimeric polynucleotide that is a man-made gene containing one (or more) artificially introduced intron(s).

The invention also provides for the generation of a chimeric polynucleotide that is a man-made gene pathway containing one (or more) artificially introduced intron(s). In one aspect, the artificially introduced intron(s) are functional in one or more host cells for gene splicing much in the way that naturally-occurring introns serve functionally in gene splicing. The invention provides a process of producing man-made intron-containing polynucleotides to be introduced into host organisms for recombination and/or splicing.

A man-made gene produced using the invention can also serve as a substrate for recombination with another nucleic acid. Likewise, a man-made gene pathway produced using the invention can also serve as a substrate for recombination with another nucleic acid. In one aspect, the recombination is facilitated by, or occurs at, areas of homology between the man-made, intron-containing gene and a nucleic acid, which serves as a recombination partner. In one aspect, the recombination partner may also be a nucleic acid generated by the invention, including a man-made gene or a man-made gene pathway. Recombination may be facilitated by or may occur at areas of homology that exist at the one (or more) artificially introduced intron(s) in the man-made gene.

In one aspect, the synthetic gene reassembly method of the invention utilizes a plurality of nucleic acid building blocks, each of which in one aspect has two ligatable ends. The two ligatable ends on each nucleic acid building block may be two blunt ends (i.e. each having an overhang of zero nucleotides), or in one aspect one blunt end and one overhang, or more in one aspect still two overhangs. In one aspect, a useful overhang for this purpose may be a 3' overhang or a 5' overhang. Thus, a nucleic acid building block may have a 3' overhang or alternatively a 5' overhang or alternatively two 3' overhangs or alternatively two 5' overhangs. The overall order in which the nucleic acid building blocks are assembled to form a finalized chimeric nucleic acid molecule is determined by purposeful experimental design and is not random.

In one aspect, a nucleic acid building block is generated by chemical synthesis of two single-stranded nucleic acids (also referred to as single-stranded oligos) and contacting them so as to allow them to anneal to form a double-stranded nucleic acid building block. A double-stranded nucleic acid building block can be of variable size. The sizes of these building blocks can be small or large. Exemplary sizes for building block range from 1 base pair (not including any overhangs) to 100,000 base pairs (not including any overhangs). Other exemplary size ranges are also provided, which have lower limits of from 1 bp to 10,000 bp (including every integer value in between) and upper limits of from 2 bp to 100,000 bp (including every integer value in between).

Many methods exist by which a double-stranded nucleic acid building block can be generated that is serviceable for the invention; and these are known in the art and can be readily performed by the skilled artisan. According to one aspect, a double-stranded nucleic acid building block is generated by first generating two single stranded nucleic acids and allowing them to anneal to form a double-stranded nucleic acid building block. The two strands of a double-stranded nucleic acid building block may be complementary at every nucleotide apart from any that form an overhang; thus containing no mismatches, apart from any overhang(s). According to another aspect, the two strands of a double-stranded nucleic acid building block are complementary at fewer than every nucleotide apart from any that form an overhang. Thus, according to this aspect, a double-stranded nucleic acid building block can be used to introduce codon degeneracy. In one aspect the codon degeneracy is introduced using the site-saturation mutagenesis described herein, using one or more N,N,G/T cassettes or alternatively using one or more N,N,N cassettes.

The in vivo recombination method of the invention can be performed blindly on a pool of unknown hybrids or alleles of a specific polynucleotide or sequence. However, it is not necessary to know the actual DNA or RNA sequence of the specific polynucleotide. The approach of using recombination within a mixed population of genes can be useful for the generation of any useful proteins, for example, a cellulase of the invention or a variant thereof. This approach may be used to generate proteins having altered specificity or activity. The approach may also be useful for the generation of hybrid nucleic acid sequences, for example, promoter regions, introns, exons, enhancer sequences, 31 untranslated regions or 51 untranslated regions of genes. Thus this approach may be used to generate genes having increased rates of expression. This approach may also be useful in the study of repetitive DNA sequences. Finally, this approach may be useful to make ribozymes or aptamers of the invention.

In one aspect the invention described herein is directed to the use of repeated cycles of reductive reassortment, recombination and selection which allow for the directed molecular evolution of highly complex linear sequences, such as DNA, RNA or proteins thorough recombination.

Optimized Directed Evolution System

The invention provides a non-stochastic gene modification system termed "optimized directed evolution system" to generate polypeptides, e.g., cellulase, e.g., endoglucanase, cellobiohydrolase, beta-glucosidase, xylanase, mannanse, β-xylosidase, arabinofuranosidase, and/or oligomerase enzymes or antibodies of the invention, with new or altered properties. In one aspect, optimized directed evolution is directed to the use of repeated cycles of reductive reassortment, recombination and selection that allow for the directed molecular evolution of nucleic acids through recombination.

Optimized directed evolution allows generation of a large population of evolved chimeric sequences, wherein the generated population is significantly enriched for sequences that have a predetermined number of crossover events. A crossover event is a point in a chimeric sequence where a shift in sequence occurs from one parental variant to another parental variant. Such a point is normally at the juncture of where oligonucleotides from two parents are ligated together to form a single sequence. This method allows calculation of the correct concentrations of oligonucleotide sequences so that the final chimeric population of sequences is enriched for the chosen number of crossover events. This provides more control over choosing chimeric variants having a predetermined number of crossover events.

In addition, this method provides a convenient means for exploring a tremendous amount of the possible protein variant space in comparison to other systems. Previously, if one generated, for example, $10^{13}$ chimeric molecules during a reaction, it would be extremely difficult to test such a high number of chimeric variants for a particular activity. Moreover, a significant portion of the progeny population would have a very high number of crossover events which resulted in proteins that were less likely to have increased levels of a particular activity. By using these methods, the population of chimerics molecules can be enriched for those variants that have a particular number of crossover events. Thus, although one can still generate $10^{13}$ chimeric molecules during a reaction, each of the molecules chosen for further analysis most likely has, for example, only three crossover events. Because the resulting progeny population can be skewed to have a predetermined number of crossover events, the boundaries on the functional variety between the chimeric molecules is reduced. This provides a more manageable number of variables when calculating which oligonucleotide from the original parental polynucleotides might be responsible for affecting a particular trait.

One method for creating a chimeric progeny polynucleotide sequence is to create oligonucleotides corresponding to fragments or portions of each parental sequence. Each oligonucleotide in one aspect includes a unique region of overlap so that mixing the oligonucleotides together results in a new variant that has each oligonucleotide fragment assembled in the correct order. Alternatively protocols for practicing these methods of the invention can be found in U.S. Pat. Nos. 6,773,900; 6,740,506; 6,713,282; 6,635,449; 6,605,449; 6,537,776; 6,361,974.

The number of oligonucleotides generated for each parental variant bears a relationship to the total number of resulting crossovers in the chimeric molecule that is ultimately created. For example, three parental nucleotide sequence variants might be provided to undergo a ligation reaction in order to find a chimeric variant having, for example, greater activity at high temperature. As one example, a set of 50 oligonucleotide sequences can be generated corresponding to each portions of each parental variant. Accordingly, during the ligation reassembly process there could be up to 50 crossover events within each of the chimeric sequences. The probability that each of the generated chimeric polynucleotides will contain oligonucleotides from each parental variant in alternating order is very low. If each oligonucleotide fragment is present in the ligation reaction in the same molar quantity it is likely that in some positions oligonucleotides from the same parental polynucleotide will ligate next to one another and thus not result in a crossover event. If the concentration of each oligonucleotide from each parent is kept constant during any ligation step in this example, there is a ⅓ chance (assuming 3 parents) that an oligonucleotide from the same parental variant will ligate within the chimeric sequence and produce no crossover.

Accordingly, a probability density function (PDF) can be determined to predict the population of crossover events that are likely to occur during each step in a ligation reaction given a set number of parental variants, a number of oligonucleotides corresponding to each variant, and the concentrations of each variant during each step in the ligation reaction. The statistics and mathematics behind determining the PDF is described below. By utilizing these methods, one can calculate such a probability density function, and thus enrich the chimeric progeny population for a predetermined number of crossover events resulting from a particular ligation reaction. Moreover, a target number of crossover events can be predetermined, and the system then programmed to calculate the starting quantities of each parental oligonucleotide during each step in the ligation reaction to result in a probability density function that centers on the predetermined number of crossover events. These methods are directed to the use of repeated cycles of reductive reassortment, recombination and selection that allow for the directed molecular evolution of a nucleic acid encoding a polypeptide through recombination. This system allows generation of a large population of evolved chimeric sequences, wherein the generated population is significantly enriched for sequences that have a predetermined number of crossover events. A crossover event is a point in a chimeric sequence where a shift in sequence occurs from one parental variant to another parental variant. Such a point is normally at the juncture of where oligonucleotides from two parents are ligated together to form a single sequence. The method allows calculation of the correct concentrations of oligonucleotide sequences so that the final chimeric population of sequences is enriched for the chosen number of crossover events. This provides more control over choosing chimeric variants having a predetermined number of crossover events.

In addition, these methods provide a convenient means for exploring a tremendous amount of the possible protein variant space in comparison to other systems. By using the methods described herein, the population of chimerics molecules can be enriched for those variants that have a particular number of crossover events. Thus, although one can still generate $10^{13}$ chimeric molecules during a reaction, each of the molecules chosen for further analysis most likely has, for example, only three crossover events. Because the resulting progeny population can be skewed to have a predetermined number of crossover events, the boundaries on the functional variety between the chimeric molecules is reduced. This provides a more manageable number of variables when calculating which oligonucleotide from the original parental polynucleotides might be responsible for affecting a particular trait.

In one aspect, the method creates a chimeric progeny polynucleotide sequence by creating oligonucleotides corresponding to fragments or portions of each parental sequence. Each oligonucleotide in one aspect includes a unique region of overlap so that mixing the oligonucleotides together results in a new variant that has each oligonucleotide fragment assembled in the correct order. See also U.S. Pat. Nos. 6,773,900; 6,740,506; 6,713,282; 6,635,449; 6,605,449; 6,537,776; 6,361,974.

Determining Crossover Events

Aspects of the invention include a system and software that receive a desired crossover probability density function (PDF), the number of parent genes to be reassembled, and the number of fragments in the reassembly as inputs. The output of this program is a "fragment PDF" that can be used to determine a recipe for producing reassembled genes, and the estimated crossover PDF of those genes. The processing described herein is in one aspect performed in MATLAB™ (The Mathworks, Natick, Mass.) a programming language and development environment for technical computing.

Iterative Processes

Any process of the invention can be iteratively repeated, e.g., a nucleic acid encoding an altered or new cellulase phenotype, e.g., endoglucanase, cellobiohydrolase, beta-glucosidase, xylanase, mannanse, β-xylosidase, arabinofuranosidase, and/or oligomerase enzyme of the invention, can be identified, re-isolated, again modified, re-tested for activity. This process can be iteratively repeated until a desired phenotype is engineered. For example, an entire biochemical anabolic or catabolic pathway can be engineered into a cell, including, e.g., cellulase, e.g., endoglucanase, cellobiohydrolase, beta-glucosidase, xylanase, mannanse, β-xylosidase, arabinofuranosidase, and/or oligomerase enzyme activity.

Similarly, if it is determined that a particular oligonucleotide has no affect at all on the desired trait (e.g., a new cellulase, e.g., endoglucanase, cellobiohydrolase, beta-glucosidase, xylanase, mannanse, β-xylosidase, arabinofuranosidase, and/or oligomerase enzyme phenotype), it can be removed as a variable by synthesizing larger parental oligonucleotides that include the sequence to be removed. Since incorporating the sequence within a larger sequence prevents any crossover events, there will no longer be any variation of this sequence in the progeny polynucleotides. This iterative practice of determining which oligonucleotides are most related to the desired trait, and which are unrelated, allows more efficient exploration all of the possible protein variants that might be provide a particular trait or activity.

In Vivo Shuffling

In various aspects, in vivo shuffling of molecules is used in methods of the invention to provide variants of polypeptides of the invention, e.g., antibodies of the invention or cellulases of the invention, e.g., endoglucanase, cellobiohydrolase, beta-glucosidase, xylanase, mannanse, β-xylosidase, arabinofuranosidase, and/or oligomerase enzymes, and the like. In vivo shuffling can be performed utilizing the natural property of cells to recombine multimers. While recombination in vivo has provided the major natural route to molecular diversity, genetic recombination remains a relatively complex process that involves 1) the recognition of homologies; 2) strand cleavage, strand invasion, and metabolic steps leading to the production of recombinant chiasma; and finally 3) the resolution of chiasma into discrete recombined molecules. The formation of the chiasma requires the recognition of homologous sequences.

In another aspect, the invention includes a method for producing a hybrid polynucleotide from at least a first polynucleotide and a second polynucleotide. The invention can be used to produce a hybrid polynucleotide by introducing at least a first polynucleotide and a second polynucleotide (e.g., one, or both, being an exemplary cellulase, e.g., endoglucanase, cellobiohydrolase, beta-glucosidase, xylanase, mannanse, βxylosidase, arabinofuranosidase, and/or oligomerase enzyme-encoding sequence of the invention) which share at least one region of partial sequence homology into a suitable host cell. The regions of partial sequence homology promote processes which result in sequence reorganization producing a hybrid polynucleotide. The term "hybrid polynucleotide", as used herein, is any nucleotide sequence which results from the method of the present invention and contains sequence from at least two original polynucleotide sequences. Such hybrid polynucleotides can result from intermolecular recombination events which promote sequence integration between DNA molecules. In addition, such hybrid polynucleotides can result from intramolecular reductive reassortment processes which utilize repeated sequences to alter a nucleotide sequence within a DNA molecule.

In one aspect, vivo reassortment focuses on "inter-molecular" processes collectively referred to as "recombination"; which in bacteria, is generally viewed as a "RecA-dependent" phenomenon. The invention can rely on recombination processes of a host cell to recombine and re-assort sequences, or the cells' ability to mediate reductive processes to decrease the complexity of quasi-repeated sequences in the cell by deletion. This process of "reductive reassortment" occurs by an "intra-molecular", RecA-independent process.

In another aspect of the invention, novel polynucleotides can be generated by the process of reductive reassortment. The method involves the generation of constructs containing consecutive sequences (original encoding sequences), their insertion into an appropriate vector and their subsequent introduction into an appropriate host cell. The reassortment of the individual molecular identities occurs by combinatorial processes between the consecutive sequences in the construct possessing regions of homology, or between quasi-repeated units. The reassortment process recombines and/or reduces the complexity and extent of the repeated sequences and results in the production of novel molecular species. Various treatments may be applied to enhance the rate of reassortment. These could include treatment with ultra-violet light, or DNA damaging chemicals and/or the use of host cell lines displaying enhanced levels of "genetic instability". Thus the reassortment process may involve homologous recombination or the natural property of quasi-repeated sequences to direct their own evolution.

Repeated or "quasi-repeated" sequences play a role in genetic instability. In one aspect, "quasi-repeats" are repeats that are not restricted to their original unit structure. Quasi-repeated units can be presented as an array of sequences in a construct; consecutive units of similar sequences. Once ligated, the junctions between the consecutive sequences become essentially invisible and the quasi-repetitive nature of the resulting construct is now continuous at the molecular level. The deletion process the cell performs to reduce the complexity of the resulting construct operates between the quasi-repeated sequences. The quasi-repeated units provide a practically limitless repertoire of templates upon which slippage events can occur. In one aspect, the constructs containing the quasi-repeats thus effectively provide sufficient molecular elasticity that deletion (and potentially insertion) events can occur virtually anywhere within the quasi-repetitive units.

When the quasi-repeated sequences are all ligated in the same orientation, for instance head to tail or vice versa, the cell cannot distinguish individual units. Consequently, the reductive process can occur throughout the sequences. In contrast, when for example, the units are presented head to head, rather than head to tail, the inversion delineates the endpoints of the adjacent unit so that deletion formation will favor the loss of discrete units. Thus, it is preferable with the present method that the sequences are in the same orientation. Random orientation of quasi-repeated sequences will result in the loss of reassortment efficiency, while consistent orientation of the sequences will offer the highest efficiency. However, while having fewer of the contiguous sequences in the same orientation decreases the efficiency, it may still provide sufficient elasticity for the effective recovery of novel molecules. Constructs can be made with the quasi-repeated sequences in the same orientation to allow higher efficiency.

Sequences can be assembled in a head to tail orientation using any of a variety of methods, including the following:
  a) Primers that include a poly-A head and poly-T tail which when made single-stranded would provide orientation can be utilized. This is accomplished by having the first few bases of the primers made from RNA and hence easily removed RNaseH.
  b) Primers that include unique restriction cleavage sites can be utilized. Multiple sites, a battery of unique sequences and repeated synthesis and ligation steps would be required.
  c) The inner few bases of the primer could be thiolated and an exonuclease used to produce properly tailed molecules.

In one aspect, the recovery of the re-assorted sequences relies on the identification of cloning vectors with a reduced repetitive index (RI). The re-assorted encoding sequences can then be recovered by amplification. The products are re-cloned and expressed. The recovery of cloning vectors with reduced RI can be affected by:
  1) The use of vectors only stably maintained when the construct is reduced in complexity.
  2) The physical recovery of shortened vectors by physical procedures. In this case, the cloning vector would be recovered using standard plasmid isolation procedures and size fractionated on either an agarose gel, or column with a low molecular weight cut off utilizing standard procedures.
  3) The recovery of vectors containing interrupted genes which can be selected when insert size decreases.
  4) The use of direct selection techniques with an expression vector and the appropriate selection.

Encoding sequences (for example, genes) from related organisms may demonstrate a high degree of homology and encode quite diverse protein products. These types of sequences are particularly useful in the present invention as quasi-repeats. However, while the examples illustrated below demonstrate the reassortment of nearly identical original encoding sequences (quasi-repeats), this process is not limited to such nearly identical repeats.

The following example demonstrates an exemplary method of the invention. Encoding nucleic acid sequences (quasi-repeats) derived from three (3) unique species are described. Each sequence encodes a protein with a distinct set of properties. Each of the sequences differs by a single or a few base pairs at a unique position in the sequence. The quasi-repeated sequences are separately or collectively amplified and ligated into random assemblies such that all possible permutations and combinations are available in the population of ligated molecules. The number of quasi-repeat units can be controlled by the assembly conditions. The average number of quasi-repeated units in a construct is defined as the repetitive index (RI).

Once formed, the constructs may, or may not be size fractionated on an agarose gel according to published protocols, inserted into a cloning vector and transfected into an appropriate host cell. The cells are then propagated and "reductive reassortment" is effected. The rate of the reductive reassortment process may be stimulated by the introduction of DNA damage if desired. Whether the reduction in RI is mediated by deletion formation between repeated sequences by an "intra-molecular" mechanism, or mediated by recombination-like events through "inter-molecular" mechanisms is immaterial. The end result is a reassortment of the molecules into all possible combinations.

Optionally, the method comprises the additional step of screening the library members of the shuffled pool to identify individual shuffled library members having the ability to bind or otherwise interact, or catalyze a particular reaction (e.g., such as catalytic domain of an enzyme) with a predetermined macromolecule, such as for example a proteinaceous receptor, an oligosaccharide, virion, or other predetermined compound or structure.

The polypeptides that are identified from such libraries can be used for therapeutic, diagnostic, research and related purposes (e.g., catalysts, solutes for increasing osmolarity of an aqueous solution and the like) and/or can be subjected to one or more additional cycles of shuffling and/or selection.

In another aspect, it is envisioned that prior to or during recombination or reassortment, polynucleotides generated by the method of the invention can be subjected to agents or processes which promote the introduction of mutations into the original polynucleotides. The introduction of such mutations would increase the diversity of resulting hybrid polynucleotides and polypeptides encoded therefrom. The agents or processes which promote mutagenesis can include, but are not limited to: (+)-CC-1065, or a synthetic analog such as (+)-CC-1065-(N3-Adenine (See Sun and Hurley, (1992); an N-acetylated or deacetylated 4'-fluoro-4-aminobiphenyl adduct capable of inhibiting DNA synthesis (See, for example, van de Poll et al. (1992)); or a N-acetylated or deacetylated 4-aminobiphenyl adduct capable of inhibiting DNA synthesis (See also, van de Poll et al. (1992), pp. 751-758); trivalent chromium, a trivalent chromium salt, a polycyclic aromatic hydrocarbon (PAH) DNA adduct capable of inhibiting DNA replication, such as 7-bromomethyl-benz[a]anthracene ("BMA"), tris(2,3-dibromopropyl)phosphate ("Tris-BP"), 1,2-dibromo-3-chloropropane ("DBCP"), 2-bromoacrolein (2BA), benzo[a]pyrene-7,8-dihydrodiol-9-10-epoxide ("BPDE"), a platinum(II) halogen salt, N-hydroxy-2-amino-3-methylimidazo[4,5-f]-quinoline ("N-hydroxy-IQ") and N-hydroxy-2-amino-1-methyl-6-phenylimidazo[4,5-f]-pyridine ("N-hydroxy-PhIP"). Exemplary means for slowing or halting PCR amplification consist of UV light (+)-CC-1065 and (+)-CC-1065-(N3-Adenine). Particularly encompassed means are DNA adducts or polynucleotides comprising the DNA adducts from the polynucleotides or polynucleotides pool, which can be released or removed by a process including heating the solution comprising the polynucleotides prior to further processing.

In another aspect the invention is directed to a method of producing recombinant proteins having biological activity by treating a sample comprising double-stranded template polynucleotides encoding a wild-type protein under conditions according to the invention which provide for the production of hybrid or re-assorted polynucleotides.

Producing Sequence Variants

The invention also provides additional methods for making sequence variants of the nucleic acid (e.g., cellulase, e.g., endoglucanase, cellobiohydrolase, beta-glucosidase, xylanase, mannanse, β-xylosidase, arabinofuranosidase, and/or oligomerase enzyme) sequences of the invention. The invention also provides additional methods for isolating cellulase, e.g., endoglucanase, cellobiohydrolase, beta-glucosidase, xylanase, mannanse, β-xylosidase, arabinofuranosidase, and/or oligomerase enzymes using the nucleic acids and polypeptides of the invention. In one aspect, the invention provides for variants of a cellulase, e.g., endoglucanase, cellobiohydrolase, beta-glucosidase, xylanase, mannanse, β-xylosidase, arabinofuranosidase, and/or oligomerase enzyme coding sequence (e.g., a gene, cDNA or message) of the invention, which can be altered by any means, including, e.g., random or stochastic methods, or, non-stochastic, or "directed evolution," methods, as described above.

The isolated variants may be naturally occurring. Variant can also be created in vitro. Variants may be created using genetic engineering techniques such as site directed mutagenesis, random chemical mutagenesis, Exonuclease III deletion procedures, and standard cloning techniques. Alternatively, such variants, fragments, analogs, or derivatives may be created using chemical synthesis or modification procedures. Other methods of making variants are also familiar to those skilled in the art. These include procedures in which nucleic acid sequences obtained from natural isolates are modified to generate nucleic acids which encode polypeptides having characteristics which enhance their value in industrial or laboratory applications. In such procedures, a large number of variant sequences having one or more nucleotide differences with respect to the sequence obtained from the natural isolate are generated and characterized. These nucleotide differences can result in amino acid changes with respect to the polypeptides encoded by the nucleic acids from the natural isolates.

For example, variants may be created using error prone PCR. In one aspect of error prone PCR, the PCR is performed under conditions where the copying fidelity of the DNA polymerase is low, such that a high rate of point mutations is obtained along the entire length of the PCR product. Error prone PCR is described, e.g., in Leung (1989) Technique 1:11-15) and Caldwell (1992) PCR Methods Applic. 2:28-33. Briefly, in such procedures, nucleic acids to be mutagenized are mixed with PCR primers, reaction buffer, $MgCl_2$, $MnCl_2$, Taq polymerase and an appropriate concentration of dNTPs for achieving a high rate of point mutation along the entire length of the PCR product. For example, the reaction may be performed using 20 fmoles of nucleic acid to be mutagenized, 30 pmole of each PCR primer, a reaction buffer comprising 50 mM KCl, 10 mM Tris HCl (pH 8.3) and 0.01% gelatin, 7 mM MgCl2, 0.5 mM $MnCl_2$, 5 units of Taq polymerase, 0.2 mM dGTP, 0.2 mM dATP, 1 mM dCTP, and 1 mM dTTP. PCR may be performed for 30 cycles of 94° C. for 1 min, 45° C. for 1 min, and 72° C. for 1 min. However, it will be appreciated that these parameters may be varied as appropriate. The mutagenized nucleic acids are cloned into an appropriate vector and the activities of the polypeptides encoded by the mutagenized nucleic acids are evaluated.

In one aspect, variants are created using oligonucleotide directed mutagenesis to generate site-specific mutations in any cloned DNA of interest. Oligonucleotide mutagenesis is described, e.g., in Reidhaar-Olson (1988) Science 241:53-57. Briefly, in such procedures a plurality of double stranded oligonucleotides bearing one or more mutations to be introduced into the cloned DNA are synthesized and inserted into the cloned DNA to be mutagenized. In one aspect, clones containing the mutagenized DNA are recovered, expressed, and the activities of the polypeptide encoded therein assessed.

Another method for generating variants is assembly PCR. Assembly PCR involves the assembly of a PCR product from a mixture of small DNA fragments. A large number of different PCR reactions occur in parallel in the same vial, with the products of one reaction priming the products of another reaction. Assembly PCR is described in, e.g., U.S. Pat. No. 5,965,408.

In one aspect, sexual PCR mutagenesis is an exemplary method of generating variants of the invention. In one aspect of sexual PCR mutagenesis forced homologous recombination occurs between DNA molecules of different but highly related DNA sequence in vitro, as a result of random fragmentation of the DNA molecule based on sequence homology, followed by fixation of the crossover by primer extension in a PCR reaction. Sexual PCR mutagenesis is described, e.g., in Stemmer (1994) Proc. Natl. Acad. Sci. USA 91:10747-10751. Briefly, in such procedures a plurality of nucleic acids to be recombined are digested with DNase to generate fragments having an average size of 50-200 nucleotides. Fragments of the desired average size are purified and resuspended in a PCR mixture. PCR is conducted under conditions which facilitate recombination between the nucleic acid fragments. For example, PCR may be performed by resuspending the purified fragments at a concentration of 10-30 ng/µl in a solution of 0.2 mM of each dNTP, 2.2 mM $MgCl_2$, 5 mM KCL, 10 mM Tris HCl, pH 9.0, and 0.1% Triton X-100. 2.5 units of Taq polymerase per 100:1 of reaction mixture is added and PCR is performed using the following regime: 94° C. for 60 seconds, 94° C. for 30 seconds, 50-55° C. for 30 seconds, 72° C. for 30 seconds (30-45 times) and 72° C. for 5 minutes. However, it will be appreciated that these parameters may be varied as appropriate. In some aspects, oligonucleotides may be included in the PCR reactions. In other aspects, the Klenow fragment of DNA polymerase I may be used in a first set of PCR reactions and Taq polymerase may be used in a subsequent set of PCR reactions. Recombinant sequences are isolated and the activities of the polypeptides they encode are assessed.

In one aspect, variants are created by in vivo mutagenesis. In some aspects, random mutations in a sequence of interest are generated by propagating the sequence of interest in a bacterial strain, such as an E. coli strain, which carries mutations in one or more of the DNA repair pathways. Such "mutator" strains have a higher random mutation rate than that of a wild-type parent. Propagating the DNA in one of these strains will eventually generate random mutations within the DNA. Mutator strains suitable for use for in vivo mutagenesis are described in PCT Publication No. WO 91/16427, published Oct. 31, 1991, entitled "Methods for Phenotype Creation from Multiple Gene Populations".

Variants may also be generated using cassette mutagenesis. In cassette mutagenesis a small region of a double stranded DNA molecule is replaced with a synthetic oligonucleotide "cassette" that differs from the native sequence. The oligonucleotide often contains completely and/or partially randomized native sequence.

Recursive ensemble mutagenesis may also be used to generate variants. Recursive ensemble mutagenesis is an algorithm for protein engineering (protein mutagenesis) developed to produce diverse populations of phenotypically related mutants whose members differ in amino acid sequence. This method uses a feedback mechanism to control successive rounds of combinatorial cassette mutagenesis. Recursive ensemble mutagenesis is described, e.g., in Arkin (1992) Proc. Natl. Acad. Sci. USA 89:7811-7815.

In some aspects, variants are created using exponential ensemble mutagenesis. Exponential ensemble mutagenesis is a process for generating combinatorial libraries with a high percentage of unique and functional mutants, wherein small groups of residues are randomized in parallel to identify, at each altered position, amino acids which lead to functional proteins. Exponential ensemble mutagenesis is described, e.g., in Delegrave (1993) Biotechnology Res. 11:1548-1552. Random and site-directed mutagenesis are described, e.g., in Arnold (1993) Current Opinion in Biotechnology 4:450-455.

In some aspects, the variants are created using shuffling procedures wherein portions of a plurality of nucleic acids which encode distinct polypeptides are fused together to create chimeric nucleic acid sequences which encode chimeric polypeptides as described in U.S. Pat. No. 5,965,408, filed Jul. 9, 1996, entitled, "Method of DNA Reassembly by Interrupting Synthesis" and U.S. Pat. No. 5,939,250, filed May 22, 1996, entitled, "Production of Enzymes Having Desired Activities by Mutagenesis.

The variants of the polypeptides of the invention may be variants in which one or more of the amino acid residues of the polypeptides of the sequences of the invention are substituted with a conserved or non-conserved amino acid residue (in one aspect a conserved amino acid residue) and such substituted amino acid residue may or may not be one encoded by the genetic code.

In one aspect, conservative substitutions are those that substitute a given amino acid in a polypeptide by another amino acid of like characteristics. In one aspect, conservative substitutions of the invention comprise the following replacements: replacements of an aliphatic amino acid such as Alanine, Valine, Leucine and Isoleucine with another aliphatic amino acid; replacement of a Serine with a Threonine or vice versa; replacement of an acidic residue such as Aspartic acid and Glutamic acid with another acidic residue; replacement of a residue bearing an amide group, such as Asparagine and Glutamine, with another residue bearing an amide group; exchange of a basic residue such as Lysine and Arginine with another basic residue; and replacement of an aromatic residue such as Phenylalanine, Tyrosine with another aromatic residue.

Other variants are those in which one or more of the amino acid residues of a polypeptide of the invention includes a substituent group. In one aspect, other variants are those in which the polypeptide is associated with another compound, such as a compound to increase the half-life of the polypeptide (for example, polyethylene glycol). Additional variants are those in which additional amino acids are fused to the polypeptide, such as a leader sequence, a secretory sequence, a proprotein sequence or a sequence which facilitates purification, enrichment, or stabilization of the polypeptide.

In some aspects, the fragments, derivatives and analogs retain the same biological function or activity as the polypeptides of the invention. In other aspects, the fragment, derivative, or analog includes a proprotein, such that the fragment, derivative, or analog can be activated by cleavage of the proprotein portion to produce an active polypeptide.

Optimizing Codons to Achieve High Levels of Protein Expression in Host Cells

The invention provides methods for modifying cellulase, e.g., endoglucanase, cellobiohydrolase, beta-glucosidase, xylanase, mannanse, β-xylosidase, arabinofuranosidase, and/or oligomerase, enzyme-encoding nucleic acids to modify (e.g., optimize) codon usage. In one aspect, the invention provides methods for modifying codons in a nucleic acid encoding a cellulase, e.g., endoglucanase, cellobiohydrolase, beta-glucosidase, xylanase, mannanse, β-xylosidase, arabinofuranosidase, and/or oligomerase enzyme to increase or decrease its expression in a host cell. The invention also provides nucleic acids encoding a cellulase, e.g., endoglucanase, cellobiohydrolase, beta-glucosidase, xylanase, mannanse, β-xylosidase, arabinofuranosidase, and/or oligomerase enzyme modified to increase its expression in a host cell, cellulase, e.g., endoglucanase, cellobiohydrolase, beta-glucosidase, xylanase, mannanse, β-xylosidase, arabinofuranosidase, and/or oligomerase enzyme so modified, and methods of making the modified cellulase, e.g., endoglucanase, cellobiohydrolase, beta-glucosidase, xylanase, mannanse, β-xylosidase, arabinofuranosidase, and/or oligomerase enzymes. The method comprises identifying a "non-preferred" or a "less preferred" codon in cellulase, e.g., endoglucanase, cellobiohydrolase, beta-glucosidase, xylanase, mannanse, β-xylosidase, arabinofuranosidase, and/or oligomerase, enzyme-encoding nucleic acid and replacing one or more of these non-preferred or less preferred codons with a "preferred codon" encoding the same amino acid as the replaced codon and at least one non-preferred or less preferred codon in the nucleic acid has been replaced by a to preferred codon encoding the same amino acid. A preferred codon is a codon over-represented in coding sequences in genes in the host cell and a non-preferred or less preferred codon is a codon under-represented in coding sequences in genes in the host cell.

Host cells for expressing the nucleic acids, expression cassettes and vectors of the invention include bacteria, yeast, fungi, plant cells, insect cells and mammalian cells (see discussion, above). Thus, the invention provides methods for optimizing codon usage in all of these cells, codon-altered nucleic acids and polypeptides made by the codon-altered nucleic acids. Exemplary host cells include gram negative bacteria, such as *Escherichia coli, Pseudomonas fluorescens*; gram positive bacteria, such as *Streptomyces* sp., *Lactobacillus gasseri, Lactococcus lactis, Lactococcus cremoris, Bacillus subtilis, Bacillus cereus*. Exemplary host cells also include eukaryotic organisms, e.g., various yeast, such as *Saccharomyces* sp., including *Saccharomyces cerevisiae, Schizosaccharomyces pombe, Pichia pastoris*, and *Kluyveromyces lactis, Hansenula polymorpha, Aspergillis niger*, and mammalian cells and cell lines and insect cells and cell lines. Thus, the invention also includes nucleic acids and polypeptides optimized for expression in these organisms and species.

For example, the codons of a nucleic acid encoding a cellulase, e.g., endoglucanase, cellobiohydrolase, beta-glucosidase, xylanase, mannanse, β-xylosidase, arabinofuranosidase, and/or oligomerase enzyme isolated from a bacterial cell are modified such that the nucleic acid is optimally expressed in a bacterial cell different from the bacteria from which the cellulase, e.g., endoglucanase, cellobiohydrolase, beta-glucosidase, xylanase, mannanse, β-xylosidase, arabinofuranosidase, and/or oligomerase enzyme was derived, a yeast, a fungi, a plant cell, an insect cell or a mammalian cell. Methods for optimizing codons are well known in the art, see, e.g., U.S. Pat. No. 5,795,737; Baca (2000) Int. J. Parasitol. 30:113-118; Hale (1998) Protein Expr. Purif. 12:185-188; Narum (2001) Infect. Immun. 69:7250-7253. See also Narum (2001) Infect. Immun. 69:7250-7253, describing optimizing codons in mouse systems; Outchkourov (2002) Protein Expr. Purif. 24:18-24, describing optimizing codons in yeast; Feng (2000) Biochemistry 39:15399-15409, describing optimizing codons in E. coli; Humphreys (2000) Protein Expr. Purif. 20:252-264, describing optimizing codon usage that affects secretion in E. coli.

Transgenic Non-Human Animals

The invention provides transgenic non-human animals comprising a nucleic acid, a polypeptide (e.g., a cellulase, e.g., endoglucanase, cellobiohydrolase, beta-glucosidase, xylanase, mannanse, β-xylosidase, arabinofuranosidase, and/or oligomerase enzyme), an expression cassette or vector or a transfected or transformed cell of the invention. The to invention also provides methods of making and using these transgenic non-human animals.

The transgenic non-human animals can be, e.g., dogs, goats, rabbits, sheep, pigs (including all swine, hogs and related animals), cows, rats and mice, comprising the nucleic acids of the invention. These animals can be used, e.g., as in vivo models to study cellulase, e.g., endoglucanase, cellobiohydrolase, beta-glucosidase, xylanase, mannanse, β-xylosidase, arabinofuranosidase, and/or oligomerase enzyme activity, or, as models to screen for agents that change the cellulase, e.g., endoglucanase, cellobiohydrolase, beta-glucosidase, xylanase, mannanse, β-xylosidase, arabinofuranosidase, and/or oligomerase enzyme activity in vivo. The coding sequences for the polypeptides to be expressed in the transgenic non-human animals can be designed to be constitutive, or, under the control of tissue-specific, developmental-specific or inducible transcriptional regulatory factors.

Transgenic non-human animals can be designed and generated using any method known in the art; see, e.g., U.S. Pat. Nos. 6,211,428; 6,187,992; 6,156,952; 6,118,044; 6,111,166; 6,107,541; 5,959,171; 5,922,854; 5,892,070; 5,880,327; 5,891,698; 5,639,940; 5,573,933; 5,387,742; 5,087,571, describing making and using transformed cells and eggs and transgenic mice, rats, rabbits, sheep, pigs and cows. See also, e.g., Pollock (1999) J. Immunol. Methods 231:147-157, describing the production of recombinant proteins in the milk of transgenic dairy animals; Baguisi (1999) Nat. Biotechnol. 17:456-461, demonstrating the production of transgenic goats. U.S. Pat. No. 6,211,428, describes making and using transgenic non-human mammals which express in their brains a nucleic acid construct comprising a DNA sequence. U.S. Pat. No. 5,387,742, describes injecting cloned recombinant or synthetic DNA sequences into fertilized mouse eggs, implanting the injected eggs in pseudo-pregnant females, and growing to term transgenic mice. U.S. Pat. No. 6,187,992, describes making and using a transgenic mouse.

"Knockout animals" can also be used to practice the methods of the invention. For example, in one aspect, the transgenic or modified animals of the invention comprise a "knockout animal," e.g., a "knockout mouse," engineered not to express an endogenous gene, which is replaced with a gene expressing a cellulase, e.g., endoglucanase, cellobiohydrolase, beta-glucosidase, xylanase, mannanse, β-xylosidase, arabinofuranosidase, and/or oligomerase enzyme of the invention, or, a fusion protein comprising a cellulase, e.g., endoglucanase, cellobiohydrolase, beta-glucosidase, xylanase, mannanse, β-xylosidase, arabinofuranosidase, and/or oligomerase enzyine of the invention.

Transgenic Plants and Seeds

The invention provides transgenic plants and seeds comprising a nucleic acid, a polypeptide (e.g., a cellulase, e.g., endoglucanase, cellobiohydrolase, beta-glucosidase, xylanase, mannanse, β-xylosidase, arabinofuranosidase, and/or oligomerase enzyme), an expression cassette or vector or a transfected or transformed cell of the invention. The invention also provides plant products, e.g., oils, seeds, leaves, extracts and the like, comprising a nucleic acid and/or a polypeptide (e.g., a cellulase, e.g., endoglucanase, cellobiohydrolase, beta-glucosidase, xylanase, mannanse, β-xylosidase, arabinofuranosidase, and/or oligomerase enzyme) of the invention. The transgenic plant can be dicotyledonous (a dicot) or monocotyledonous (a monocot). The invention also provides methods of making and using these transgenic plants and seeds. The transgenic plant or plant cell expressing a polypeptide of the present invention may be constructed in accordance with any method known in the art. See, for example, U.S. Pat. No. 6,309,872.

Nucleic acids and expression constructs of the invention can be introduced into a plant cell by any means. For example, nucleic acids or expression constructs can be introduced into the genome of a desired plant host, or, the nucleic acids or expression constructs can be episomes. Introduction into the genome of a desired plant can be such that the host's cellulase, e.g., endoglucanase, cellobiohydrolase, beta-glucosidase, xylanase, mannanse, β-xylosidase, arabinofuranosidase, and/or oligomerase enzyme production is regulated by endogenous transcriptional or translational control elements. The invention also provides "knockout plants" where insertion of gene sequence by, e.g., homologous recombination, has disrupted the expression of the endogenous gene. Means to generate "knockout" plants are well-known in the art, see, e.g., Strepp (1998) Proc Natl. Acad. Sci. USA 95:4368-4373; Miao (1995) Plant J7:359-365. See discussion on transgenic plants, below.

The nucleic acids of the invention can be used to confer desired traits on essentially any plant, e.g., on starch-producing plants, such as potato, tomato, soybean, beets, corn, wheat, rice, barley, and the like. Nucleic acids of the invention can be used to manipulate metabolic pathways of a plant in order to optimize or alter host's expression of cellulase, e.g., endoglucanase, cellobiohydrolase, beta-glucosidase, xylanase, mannanse, β-xylosidase, arabinofuranosidase, and/or oligomerase enzyme. The can change cellulase, e.g., endoglucanase, cellobiohydrolase, beta-glucosidase, xylanase, mannanse, β-xylosidase, arabinofuranosidase, and/or oligomerase enzyme activity in a plant. Alternatively, a cellulase, e.g., endoglucanase, cellobiohydrolase, beta-glucosidase, xylanase, mannanse, β-xylosidase, arabinofuranosidase, and/or oligomerase enzyme of the invention can be used in production of a transgenic plant to produce a compound not naturally produced by that plant. This can lower production costs or create a novel product.

In one aspect, the first step in production of a transgenic plant involves making an expression construct for expression in a plant cell. These techniques are well known in the art. They can include selecting and cloning a promoter, a coding sequence for facilitating efficient binding of ribosomes to mRNA and selecting the appropriate gene terminator sequences. One exemplary constitutive promoter is CaMV35S, from the cauliflower mosaic virus, which generally results in a high degree of expression in plants. Other promoters are more specific and respond to cues in the plant's internal or external environment. An exemplary light-inducible promoter is the promoter from the cab gene, encoding the major chlorophyll a/b binding protein.

In one aspect, the nucleic acid is modified to achieve greater expression in a plant cell. For example, a sequence of the invention is likely to have a higher percentage of A-T nucleotide pairs compared to that seen in a plant, some of which prefer G-C nucleotide pairs. Therefore, A-T nucleotides in the coding sequence can be substituted with G-C nucleotides without significantly changing the amino acid sequence to enhance production of the gene product in plant cells.

Selectable marker gene can be added to the gene construct in order to identify plant cells or tissues that have successfully integrated the transgene. This may be necessary because achieving incorporation and expression of genes in plant cells is a rare event, occurring in just a few percent of the targeted tissues or cells. Selectable marker genes encode proteins that provide resistance to agents that are normally toxic to plants, such as antibiotics or herbicides. Only plant cells that have integrated the selectable marker gene will survive when grown on a medium containing the appropriate antibiotic or herbicide. As for other inserted genes, marker genes also require promoter and termination sequences for proper function.

In one aspect, making transgenic plants or seeds comprises incorporating sequences of the invention and, optionally, marker genes into a target expression construct (e.g., a plasmid), along with positioning of the promoter and the terminator sequences. This can involve transferring the modified gene into the plant through a suitable method. For example, a construct may be introduced directly into the genomic DNA of the plant cell using techniques such as electroporation and microinjection of plant cell protoplasts, or the constructs can be introduced directly to plant tissue using ballistic methods, such as DNA particle bombardment. For example, see, e.g., Christou (1997) Plant Mol. Biol. 35:197-203; Pawlowski (1996) Mol. Biotechnol. 6:17-30; Klein (1987) Nature 327:70-73; Takumi (1997) Genes Genet. Syst. 72:63-69, discussing use of particle bombardment to introduce transgenes into wheat; and Adam (1997) supra, for use of particle bombardment to introduce YACs into plant cells. For example, Rinehart (1997) supra, used particle bombardment to generate transgenic cotton plants. Apparatus for accelerating particles is described U.S. Pat. No. 5,015,580; and, the commercially available BioRad (Biolistics) PDS-2000 particle acceleration instrument; see also, John, U.S. Pat. No. 5,608,148; and Ellis, U.S. Pat. No. 5,681,730, describing particle-mediated transformation of gymnosperms.

In one aspect, protoplasts can be immobilized and injected with a nucleic acids, e.g., an expression construct. Although plant regeneration from protoplasts is not easy with cereals, plant regeneration is possible in legumes using somatic embryogenesis from protoplast derived callus. Organized tissues can be transformed with naked DNA using gene gun technique, where DNA is coated on tungsten microprojectiles, shot 1/100th the size of cells, which carry the DNA deep into cells and organelles. Transformed tissue is then induced to regenerate, usually by somatic embryogenesis. This technique has been successful in several cereal species including maize and rice.

Nucleic acids, e.g., expression constructs, can also be introduced in to plant cells using recombinant viruses. Plant cells can be transformed using viral vectors, such as, e.g., tobacco mosaic virus derived vectors (Rouwendal (1997) Plant Mol. Biol. 33:989-999), see Porta (1996) "Use of viral replicons for the expression of genes in plants," Mol. Biotechnol. 5:209-221.

Alternatively, nucleic acids, e.g., an expression construct, can be combined with suitable T-DNA flanking regions and introduced into a conventional *Agrobacterium tumefaciens* host vector. The virulence functions of the *Agrobacterium tumefaciens* host will direct the insertion of the construct and adjacent marker into the plant cell DNA when the cell is infected by the bacteria. *Agrobacterium tumefaciens*-mediated transformation techniques, including disarming and use of binary vectors, are well described in the scientific literature. See, e.g., Horsch (1984) *Science* 233:496-498; Fraley (1983) *Proc. Natl. Acad. Sci. USA* 80:4803 (1983); *Gene Transfer to Plants*, Potrykus, ed. (Springer-Verlag, Berlin 1995). The DNA in an *A. tumefaciens* cell is contained in the bacterial chromosome as well as in another structure known as a Ti (tumor-inducing) plasmid. The Ti plasmid contains a stretch of DNA termed T-DNA (~20 kb long) that is transferred to the plant cell in the infection process and a series of vir (virulence) genes that direct the infection process. *A. tumefaciens* can only infect a plant through wounds: when a plant root or stem is wounded it gives off certain chemical signals, in response to which, the vir genes of *A. tumefaciens* become activated and direct a series of events necessary for the transfer of the T-DNA from the Ti plasmid to the plant's chromosome. The T-DNA then enters the plant cell through the wound. One speculation is that the T-DNA waits until the plant DNA is being replicated or transcribed, then inserts itself into the exposed plant DNA. In order to use *A. tumefaciens* as a transgene vector, the tumor-inducing section of T-DNA have to be removed, while retaining the T-DNA border regions and the vir genes. The transgene is then inserted between the T-DNA border regions, where it is transferred to the plant cell and becomes integrated into the plant's chromosomes.

The invention provides for the transformation of monocotyledonous plants using the nucleic acids of the invention, including important cereals, see Hiei (1997) Plant Mol. Biol. 35:205-218. See also, e.g., Horsch, Science (1984) 233:496; Fraley (1983) Proc. Natl. Acad. Sci. USA 80:4803; Thykjaer (1997) supra; Park (1996) Plant Mol. Biol. 32:1135-1148, discussing T-DNA integration into genomic DNA. See also D'Halluin, U.S. Pat. No. 5,712,135, describing a process for the stable integration of a DNA comprising a gene that is functional in a cell of a cereal, or other monocotyledonous plant.

In one aspect, the third step involves selection and regeneration of whole plants capable of transmitting the incorporated target gene to the next generation. Such regeneration techniques may use manipulation of certain phytohormones in a tissue culture growth medium. In one aspect, the method uses a biocide and/or herbicide marker that has been introduced together with the desired nucleotide sequences. Plant regeneration from cultured protoplasts is described in Evans et al., *Protoplasts Isolation and Culture, Handbook of Plant Cell Culture*, pp. 124-176, MacMillilan Publishing Company, New York, 1983; and Binding, *Regeneration of Plants, Plant Protoplasts*, pp. 21-73, CRC Press, Boca Raton, 1985. Regeneration can also be obtained from plant callus, explants, organs, or parts thereof. Such regeneration techniques are described generally in Klee (1987) Ann. Rev. of Plant Phys. 38:467-486. To obtain whole plants from transgenic tissues such as immature embryos, they can be grown under controlled environmental conditions in a series of media containing nutrients and hormones, a process known as tissue culture. Once whole plants are generated and produce seed, evaluation of the progeny begins.

In one aspect, after the expression cassette is stably incorporated in transgenic plants, it can be introduced into other plants by sexual crossing. Any of a number of standard breeding techniques can be used, depending upon the species to be crossed. Since transgenic expression of the nucleic acids of the invention leads to phenotypic changes, plants comprising the recombinant nucleic acids of the invention can be sexually crossed with a second plant to obtain a final product. Thus, the seed of the invention can be derived from a cross between two transgenic plants of the invention, or a cross between a plant of the invention and another plant. The desired effects (e.g., expression of the polypeptides of the invention to produce a plant in which flowering behavior is altered) can be enhanced when both parental plants express the polypeptides (e.g., a cellulase, e.g., endoglucanase, cellobiohydrolase, beta-glucosidase, xylanase, mannanse, β-xylosidase, arabinofuranosidase, and/or oligomerase enzyme) of the invention. The desired effects can be passed to future plant generations by standard propagation means.

In one aspect, the nucleic acids and polypeptides of the invention are expressed in or inserted in any plant or seed. Transgenic plants of the invention can be dicotyledonous or monocotyledonous. Examples of monocot transgenic plants of the invention are grasses, such as meadow grass (blue grass, *Poa*), forage grass such as *festuca, lolium*, temperate grass, such as *Agrostis*, and cereals, e.g., wheat, oats, rye, barley, rice, sorghum, and maize (corn). Examples of dicot transgenic plants of the invention are tobacco, legumes, such as lupins, potato, sugar beet, pea, bean and soybean, and cruciferous plants (family Brassicaceae), such as cauliflower, rape seed, and the closely related model organism *Arabidopsis thaliana*. Thus, the transgenic plants and seeds of the invention include a broad range of plants, including, but not limited to, species from the genera *Anacardium, Arachis, Asparagus, Atropa, Avena, Brassica, Citrus, Citrullus, Capsicum, Carthamus, Cocos, Coffea, Cticumis, Cucurbita, Daucus, Elaeis, Fragaria, Glycine, Gossypium, Helianthus, Heterocallis, Hordeum, Hyoscyamus, Lactuca, Linum, Lolium, Lupinus, Lycopersicon, Malus, Manihot, Majorana, Medicago, Nicotiana, Olea, Oryza, Panieum, Pannisetum, Persea, Phaseolus, Pistachia, Pisum, Pyrus, Prunus, Raphanus, Ricinus, Secale, Senecio, Sinapis, Solanum, Sorghum, Theobromus, Trigonella, Triticum, Vicia, Vitis, Vigna,* and *Zea*.

In alternative embodiments, the nucleic acids of the invention are expressed in plants which contain fiber cells, including, e.g., cotton, silk cotton tree (Kapok, Ceiba pentandra), desert willow, creosote bush, winterfat, balsa, ramie, kenaf, hemp, roselle, jute, sisal abaca and flax. In alternative embodiments, the transgenic plants of the invention can be members of the genus *Gossypiurm*, including members of any *Gossypium* species, such as *G. arboreum; G. herbaceum, G. barbadense,* and *G. hirsutum*.

The invention also provides for transgenic plants to be used for producing large amounts of the polypeptides (e.g., a cellulase, e.g., endoglucanase, cellobiohydrolase, beta-glucosidase, xylanase, mannanse, β-xylosidase, arabinofuranosidase, and/or oligomerase enzyme or antibody) of the invention. For example, see Palmgren (1997) Trends Genet. 13:348; Chong (1997) Transgenic Res. 6:289-296 (producing human milk protein beta-casein in transgenic potato plants using an auxin-inducible, bidirectional mannopine synthase (mas1',2') promoter with *Agrobacterium tumefaciens*-mediated leaf disc transformation methods).

Using known procedures, one of skill can screen for plants of the invention by detecting the increase or decrease of transgene mRNA or protein in transgenic plants. Means for detecting and quantitation of mRNAs or proteins are well known in the art.

Polypeptides and Peptides

In one aspect, the invention provides isolated, synthetic or recombinant polypeptides having a sequence identity (e.g., at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity, or homology) to an exemplary sequence of the invention, e.g., proteins having the sequence of SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:143, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:209, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO: 436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO:490, SEQ ID NO:492, SEQ ID NO:494, SEQ ID NO:496, SEQ ID NO:498, SEQ ID NO:500, SEQ ID NO:502, SEQ ID NO:504, SEQ ID NO:506, SEQ ID NO:508, SEQ ID NO:510, SEQ ID NO:512, SEQ ID NO:514, SEQ ID NO:516, SEQ ID NO:518, SEQ ID NO:520, SEQ ID NO:522 and/or SEQ ID NO:524 see also Tables 1, 2, and 3, Examples 1 and 4, below, and Sequence Listing)). The percent sequence identity can be over the full length of the polypeptide, or, the identity can be over a region of at least about 15, 20, 25, 30, 35, 40, 45, 50, 60, 70, 80, 90, 100, 125, 150, 175, 200, 250, 300, 350, 400, 450, 500, 550, 600, 650, 700 or more residues.

Polypeptides of the invention can also be shorter than the full length of exemplary polypeptides. In alternative aspects, the invention provides polypeptides (peptides, fragments) ranging in size between about 5 and the full length of a polypeptide, e.g., an enzyme, such as a cellulase, e.g., endoglucanase, cellobiohydrolase, beta-glucosidase, xylanase, mannanse, β-xylosidase, arabinofuranosidase, and/or oligomerase enzyme; exemplary sizes being of about 5, 10, 15, 20, 25, 30, 35, 40, 45, 50, 55, 60, 65, 70, 75, 80, 85, 90, 100, 125, 150, 175, 200, 250, 300, 350, 400, 450, 500, 550, 600, 650, 700, or more residues, e.g., contiguous residues of an exemplary cellulase, e.g., endoglucanase, cellobiohydrolase, beta-glucosidase, xylanase, mannanse, β-xylosidase, arabinofuranosidase, and/or oligomerase enzyme of the invention. Peptides of the invention (e.g., a subsequence of an exemplary polypeptide of the invention) can be useful as, e.g., labeling probes, antigens (immunogens), toleragens, motifs, cellulase, e.g., endoglucanase, cellobiohydrolase, beta-glucosidase, xylanase, mannanse, β-xylosidase, arabinofuranosidase, and/or oligomerase enzyme active sites (e.g., "catalytic domains"), signal sequences and/or prepro domains.

In alternative aspects, polypeptides having cellulolytic activity, e.g., cellulases activity, such as endoglucanase, cellobiohydrolase and/or β-glucosidase (beta-glucosidase) activity, are members of a genus of polypeptides sharing specific structural elements, e.g., amino acid residues, that correlate with cellulolytic activity such as cellulase activity, e.g., endoglucanase, cellobiohydrolase, beta-glucosidase, xylanase, mannanse, β-xylosidase, arabinofuranosidase, and/or oligomerase activity. These shared structural elements can be used for the routine generation of cellulase, e.g., endoglucanase, cellobiohydrolase, beta-glucosidase, xylanase, mannanse, β-xylosidase, arabinofuranosidase, and/or oligomerase variants. These shared structural elements of cellulase, e.g., endoglucanase, cellobiohydrolase, beta-glucosidase, xylanase, mannanse, β-xylosidase, arabinofuranosidase, and/or oligomerase enzymes of the invention can be used as guidance for the routine generation of cellulase, e.g., endoglucanase, cellobiohydrolase, beta-glucosidase, xylanase, mannanse, β-xylosidase, arabinofuranosidase, and/or oligomerase enzymes variants within the scope of the genus of polypeptides of the invention.

As used herein, the terms "cellulase, e.g., endoglucanase, cellobiohydrolase, beta-glucosidase, xylanase, mannanse, β-xylosidase, arabinofuranosidase, and/or oligomerase" encompass, but is not limited to, any polypeptide or enzymes capable of catalyzing the complete or partial breakdown and/or hydrolysis of cellulose (e.g., exemplary polypeptides of the invention, see also Tables 1, 2, and 3, Examples 1 to 7, below), or any modification or hydrolysis of a cellulose, a hemicellulose or a lignocellulotic material, e.g., a biomass material comprising cellulose, hemicellulose and lignin.

The following chart summarizes exemplary enzymatic activities of exemplary polypeptides of the invention, for example, as indicated by this chart, in alternative aspects to these exemplary polypeptides have, but are not limited to, the following activities:

the polypeptide having the sequence of SEQ ID NO:2 (encoded by, e.g., SEQ ID NO:1), has cellobiohydrolase activity.

the polypeptide having the sequence of SEQ ID NO:102 (encoded by, e.g., SEQ ID NO:101), has esterase, or more particularly, Glycoside hydrolase activity.

the polypeptide having the sequence of SEQ ID NO:104 (encoded by, e.g., SEQ ID NO:103), has glycosyl hydrolase activity.

the polypeptide having the sequence of SEQ ID NO:106 (encoded by, e.g., SEQ ID NO:105), has glycoside hydrolase activity.

the polypeptide having the sequence of SEQ ID NO:108 (encoded by, e.g., SEQ ID NO:107), has endoglucanase activity.

the polypeptide having the sequence of SEQ ID NO:110 (encoded by, e.g., SEQ ID NO:109), has endo-1,4-beta-glucanase activity the polypeptide having the sequence of SEQ ID NO:12 (encoded by, e.g., SEQ ID NO:11), has cellobiohydrolase II activity.

the polypeptide having the sequence of SEQ ID NO:112 (encoded by, e.g., SEQ ID NO:111), has endo-1,4-beta-glucanase activity.

the polypeptide having the sequence of SEQ ID NO:114 (encoded by, e.g., SEQ ID NO:113), has endo-14-beta-glucanase activity.

the polypeptide having the sequence of SEQ ID NO:116 (encoded by, e.g., SEQ ID NO:115), has endoglucanase activity.

the polypeptide having the sequence of SEQ ID NO:118 (encoded by, e.g., SEQ ID NO:117), has dockerin type I, glycoside hydrolase activity.

the polypeptide having the sequence of SEQ ID NO:120 (encoded by, e.g., SEQ ID NO:119), has 4-beta-cellobiosidase activity.

etc., see below:

| SEQ ID NO: | Activity Assignment | Exemplary function based on sequence identity (homology) (using BLAST) |
|---|---|---|
| 1, 2 | Cellobiohydrolase | cellobiohydrolase |
| 101, 102 | | Esterase: Glycoside hydrolase, family 10: *Clostridium* cellulosome enzyme, dockerin type I: Carbohydrate binding module, family 6 |
| 103, 104 | | [*Clostridium* thermocellum ATCC 27405] gi|67849757|gb|EAM45352.1|esterase: Glycoside hydrolase, family 10: Clostr glycosyl hydrolase, [*Aspergillus fumigatus* Af293] gi|70988747|ref|XP_749229.1|glycosyl hydrolase [*Aspergillus fumigatus* Af293] |
| 105, 106 | | Lipolytic enzyme, G-D-S-L: Glycoside hydrolase, family 5: *Clostridium* cellulosome enzyme, dockerin type I [*Clostridium* thermocellum ATCC 27405] gi|67850336|gb|EAM45917.1|Lipolytic enzyme, G-D-S-L: Glycoside hydrolase, family 5: *Clostridium* cellulosome enzyme |
| 107, 108 | | endoglucanase [*Thermotoga maritima* MSB8] |
| 109, 110 | | endo-1;4-beta-glucanase [*Cellvibrio japonicus*] |
| 11, 12 | Cellobiohydrolase | cellobiohydrolase II [*Talaromyces emersonii*]. |
| 111, 112 | | endo-1;4-beta-glucanase [*Cellvibrio japonicus*] |
| 113, 114 | | endo-1;4-beta-glucanase [*Cellvibrio japonicus*] |
| 115, 116 | | endoglucanase [*Anaerocellum thermophilum*]. |
| 117, 118 | | Glycoside hydrolase, family 8: *Clostridium* cellulosome enzyme, dockerin type I [*Clostridium* thermocellum ATCC 27405] gi|67851770|gb|EAM47333.1|Glycoside hydrolase, family 8: *Clostridium* cellulosome enzyme, dockerin type I [*Clostridium* thermocellum ATCC 274 |
| 119, 120 | | cellulose 1;4-beta-cellobiosidase [*Streptomyces avermitilis* MA-4680] |
| 121, 122 | | secreted hydrolase [*Streptomyces coelicolor* A3(2)] |
| 123, 124 | | ENDOGLUCANASE A PRECURSOR (ENDO-1,4-BETA-GLUCANASE) (CELLULASE). |
| 125, 126 | | E1 beta-1;4-endoglucanase precursor [*Acidothermus cellulolyticus*] |
| 127, 128 | | endo-beta-1,4-glucanase; McenA [*Micromonospora cellulolyticum*]. |
| 129, 130 | | endoglucanase [*Thermotoga maritima* MSB8] |
| 13, 14 | B-glucosidase | Beta-glucosidase/6-phospho-beta-glucosidase/beta-galactosidase [*Thermoanaerobacter tengcongensis*]. |
| 131, 132 | | probable endoglucanase precursor [*Salmonella enterica* subsp. *enterica* serovar Paratyphi A str. ATCC 9150] |
| 133, 134 | | Cellulase [*Ralstonia eutropha* JMP134] |
| 135, 136 | | endo-1;4-beta-glucanase [*Cellvibrio japonicus*] |
| 137, 138 | | cellulase A [*Cellvibrio mixtus*]. |
| 139, 140 | | endo-1;4-beta-D-glucanase [*uncultured bacterium*] |
| 141, 142 | | cellulase B [*Cellvibrio mixtus*]. |
| 143, 144 | | ENDOGLUCANASE X (EGX) (ENDO-1,4-BETA-GLUCANASE) (CELLULASE). |
| 145, 146 | | Glycoside hydrolase, family 9: *Clostridium* cellulosome enzyme, dockerin type I: Glycoside hydrolase, family 9, N-terminal, Ig-like [*Clostridium* thermocellum ATCC 27405] gi|67850314|gb|EAM45895.1|Glycoside hydrolase, family 9: *Clostridium* cellulosome enzyme, |
| 147, 148 | β-glucosidase | XYLOSIDASE/ARABINOSIDASE [INCLUDES: BETA-XYLOSIDASE (1,4-BETA-D-XYLAN XYLOHYDROLASE) (XYLAN 1,4-BETA-XYLOSIDASE); ALPHA-L-ARABINOFURANOSIDASE (ARABINOSIDASE)]. |
| 149, 150 | β-glucosidase | Beta-glycosidase (lacS) [*Sulfolobus solfataricus* P2] |
| 15, 16 | B-glucosidase | COG1472: Beta-glucosidase-related glycosidases [*Cytophaga hutchinsonii*] |
| 151, 152 | | endoglucanase [*Thermotoga maritima* MSB8] |
| 153, 154 | | endoglucanase [*Thermotoga maritima* MSB8] |
| 155, 156 | | chitinase; containing dual catalytic domains [*Thermococcus kodakarensis* KOD1] |
| 157, 158 | | COG3405: Endoglucanase Y [*Escherichia coli* E22] gi|75237469|ref|ZP_00721502.1|COG3405: Endoglucanase Y [*Escherichia coli* E110019] gi|75231623|ref|ZP_00717981.1|COG3405: Endoglucanase Y [*Escherichia coli* B7A] gi|75210076|ref|ZP_00710255.1|COG3405: Endog |
| 159, 160 | | endo-1;4-beta-glucanase [*Bacillus subtilis* subsp. *subtilis* str. 168] |
| 161, 162 | | beta-1,4-glucanase [*Clostridium cellulolyticum*]. |
| 163, 164 | β-glucosidase | 1;4-beta-D-glucan glucohydrolase [*Microbulbifer hydrolyticus*] |
| 165, 166 | | endoglucanase [*Thermotoga maritima* MSB8] |
| 167, 168 | | COG2730: Endoglucanase [*Microbulbifer degradans* 2-40] |
| 169, 170 | | COG2730: Endoglucanase [*Microbulbifer degradans* 2-40] |
| 17, 18 | B-glucosidase | beta-glucosidase [*Streptomyces coelicolor* A3(2)] |
| 171, 172 | β-glucosidase | beta-glucosidase [*Streptomyces coelicolor* A3(2)] |
| 173, 174 | | cellulase (EC 3.2.1.4), alkaline - *Bacillus* sp. (strain KSM-S237). |
| 175, 176 | | COG2730: Endoglucanase [*Microbulbifer degradans* 2-40] |
| 177, 178 | | COG2730: Endoglucanase [*Microbulbifer degradans* 2-40] |
| 179, 180 | β-glucosidase | BgIY [*Paenibacillus* sp. C7] |
| 181, 182 | | endoglucanase [*Anaerocellum thermophilum*]. |
| 183, 184 | | endoglucanase [*Anaerocellum thermophilum*]. |
| 185, 186 | | endoglucanase [*Anaerocellum thermophilum*]. |
| 187, 188 | β-glucosidase | beta-glycosidase [*Thermosphaera aggregans*] |
| 189, 190 | | probable endoglucanase precursor [*Salmonella enterica* subsp. *enterica* serovar Paratyphi A str. ATCC 9150] |
| 19, 20 | Cellobiohydrolase | cellobiohydrolase II [*Acremonium cellulolyticus* Y-94]. |
| 191, 192 | | cellulase [*Spirotrichonympha leidyi*] |
| 193, 194 | | ENDOGLUCANASE PRECURSOR (ENDO-1,4-BETA-GLUCANASE) (CELLULASE). |
| 195, 196 | | endo-1;4-beta-glucanase; Glycoside hydrolase Family 5 [*Bacillus licheniformis* ATCC 14580] |
| 197, 198 | | endoglucanase [*Thermotoga maritima* MSB8] |
| 199, 200 | | endoglucanase fragment [*Aquifex aeolicus* VF5] |
| 201, 202 | | COG3405: Endoglucanase Y [*Cytophaga hutchinsonii*] |
| 203, 204 | | endo-1,4-beta-D-glucanase precursor [*Pectobacterium chrysanthemi*]. |
| 205, 206 | | COG5297: Cellobiohydrolase A (1;4-beta-cellobiosidase A) [*Microbulbifer degradans* 2-40] |
| 207, 208 | | probable endoglucanase precursor [*Salmonella enterica* subsp. *enterica* serovar Paratyphi A str. ATCC 9150] |
| 209, 210 | | ENDOGLUCANASE PRECURSOR (ENDO-1,4-BETA-GLUCANASE) (CELLULASE). |

-continued

| SEQ ID NO: | Activity Assignment | Exemplary function based on sequence identity (homology) (using BLAST) |
|---|---|---|
| 21, 22 | Cellobiohydrolase | hypothetical protein MG07809.4 [*Magnaporthe grisea* 70-15] ref|XP_367905.1|hypothetical protein MG07809.4 [*Magnaporthe grisea* 70-15] Glycoside hydrolase, family 1 [*Solibacter usitatus* Ellin6076] gi|67858748|gb|EAM53848.1|Glycoside hydrolase, family 1 [*Solibacter usitatus* Ellin6076] |
| 211, 212 | β-glucosidase | |
| 213, 214 | | endo-1;4-beta-glucanase b [*Pyrococcus furiosus* DSM 3638] |
| 215, 216 | | endo-1;4-beta-glucanase b [*Pyrococcus furiosus* DSM 3638] |
| 217, 218 | | endoglucanase [*Thermotoga maritima* MSB8] |
| 219, 220 | | cellulase A [*Cellvibrio mixtus*]. |
| 221, 222 | | ENDOGLUCANASE A PRECURSOR (ENDO-1,4-BETA-GLUCANASE) (CELLULASE A) (EG-A). |
| 223, 224 | | cellulase [*Streptomyces halstedii*] |
| 225, 226 | β-glucosidase | Beta-glucosidase [*Burkholderia* sp. 383] |
| 227, 228 | β-glucosidase | Glycoside hydrolase, family 1 [*Solibacter usitatus* Ellin6076] gi|67858748|gb|EAM53848.1|Glycoside hydrolase, family 1 [*Solibacter usitatus* Ellin6076] |
| 229, 230 | β-glucosidase | beta-glucosidase [*Streptomyces avermitilis* MA-4680] |
| 23, 24 | B-glucosidase | COG1472: Beta-glucosidase-related glycosidases [*Clostridium thermocellum* ATCC 27405] |
| 231, 232 | | xylanase [*Bifidobacterium adolescentis*] |
| 233, 234 | | B-1,4-endoglucanase [*Prevotelia bryantii*]. |
| 235, 236 | | cellulase A [*Cellvibrio mixtus*]. |
| 237, 238 | | B-1,4-endoglucanase [*Prevotella bryantii*]. |
| 239, 240 | | endoglucanase A [*Ruminococcus albus*] |
| 241, 242 | | COG3405: Endoglucanase Y [*Escherichia coli* F11] |
| 243, 244 | | yvfO [*Bacillus subtilis* subsp. *subtilis* str. 168] |
| 245, 246 | | BH2023 [*Bacillus halodurans* C-125] |
| 247, 248 | | BH2023 [*Bacillus halodurans* C-125] |
| 249, 250 | β-glucosidase | beta-glucosidase [*Pyrococcus furiosus*] |
| 25, 26 | Cellobiohydrolase | cellobiohydrolase [*Irpex lacteus*] |
| 251, 252 | β-glucosidase | beta-glucosidase [*Pyrococcus furiosus*] |
| 253, 254 | β-glucosidase | beta-glucosidase [*Thermotoga maritima* MSB8] |
| 255, 256 | | endoglucanase-N257 [*Bacillus circulans*]. |
| 257, 258 | | cellulase; endo-beta-1,4-glucanase [*Bacillus subtilis*]. |
| 259, 260 | | cellulase [*Spirotrichonympha leidyi*] |
| 261, 262 | | endo-1;4-beta-glucanase b [*Pyrococcus furiosus* DSM 3638] |
| 263, 264 | β-glucosidase | beta-glucosidase [*Pyrococcus furiosus*] |
| 265, 266 | β-glucosidase | beta-glucosidase [*Streptomyces coelicolor* A3(2)] |
| 267, 268 | | beta-1,4-endoglucanase [*Cellulomonas pachnodae*]. |
| 269, 270 | | cellulase [*Streptomyces halstedii*] |
| 27, 28 | Cellobiohydrolase | hypothetical protein MG04499.4 [*Magnaporthe grisea* 70-15] ref|XP_362054.1|hypothetical protein MG04499.4 [*Magnaporthe grisea* 70-15] |
| 271, 272 | β-glucosidase | beta-glucosidase [*Streptomyces coelicolor* A3(2)] |
| 273, 274 | | cellulase [*Pseudomonas* sp. ND137]. |
| 275, 276 | | beta(1;4)-glucan glucanohydrolase precursor [*Pectobacterium carotovorum* subsp. *carotovorum*] |
| 277, 278 | | COG2730: Endoglucanase [*Cytophaga hutchinsonii*] |
| 279, 280 | | cellulase [*uncultured bacterium*] |
| 281, 282 | | secreted endoglucanase. [*Streptomyces coelicolor* A3(2)] |
| 283, 284 | | E1 beta-1;4-endoglucanase precursor [*Acidothermus cellulolyticus*] |
| 285, 286 | | ENDOGLUCANASE PRECURSOR (ENDO-1,4-BETA-GLUCANASE) (ALKALINE CELLULASE). |
| 287, 288 | | COG2730: Endoglucanase [*Cytophaga hutchinsonii*] |
| 289, 290 | | ENDOGLUCANASE PRECURSOR (ENDO-1;4-BETA-GLUCANASE) PROTEIN [*Ralstonia solanacearum*] |
| 29, 30 | B-glucosidase | COG2723: Beta-glucosidase/6-phospho-beta-glucosidase/beta-galactosidase [*Novosphingobium aromaticivorans* DSM 12444] |
| 291, 292 | | PKD: Glycoside hydrolase, family 9: *Clostridium* cellulosome enzyme, dockerin type I: Glycoside hydrolase, family 9, N-terminal, Ig-like [*Clostridium thermocellum* ATCC 27405] gi|67850728|gb|EAM46301.1|PKD: Glycoside hydrolase, family 9: *Clostridium* cellulosome |
| 293, 294 | | endoglucanase [*Anaerocellum thermophilum*]. |
| 295, 296 | | Cellulase [*Frankia* sp. EAN1pec] gi|68196961|gb|EAN11335.1|Cellulase [*Frankia* sp. EAN1pec] |
| 297, 298 | β-glucosidase | beta-glucosidase (gentiobiase) [*Bacteroides thetaiotaomicron* VPI-5482] |
| 299, 300 | | COG2730: Endoglucanase [*Cytophaga hutchinsonii*] |
| 3, 4 | B-glucosidase | glucan 1,4-beta-glucosidase [*Xanthomonas axonopodis* pv. citri str. 306]. |
| 301, 302 | | cellulase A [*Cellvibrio mixtus*]. |
| 303, 304 | β-glucosidase | beta-glucosidase [*uncultured bacterium*] |
| 305, 306 | | Glycoside hydrolase, family 5 [*Clostridium thermocellum* ATCC 27405] gi|67850654|gb|EAM46228.1|Glycoside hydrolase, family 5 [*Clostridium thermocellum* ATCC 27405] gi|121821|sp|P23340|GUNC_CLOSF Endoglucanase C307 precursor (Endo-1,4-beta-glucanase) (Cellu |
| 307, 308 | | beta-1;4-endoglucanase precursor [*Thermobifida fusca*] |
| 309, 310 | β-glucosidase | N-acetyl-beta-glucosaminidase [*Cellulomonas fimi*]. |
| 31, 32 | B-glucosidase | beta-glucosidase [*Thermotoga maritima*] |
| 311, 312 | β-glucosidase | Glycoside hydrolase, family 3, N-terminal: Glycoside hydrolase, family 3, C-terminal [*Clostridium thermocellum* ATCC 27405] gi|67851719|gb|EAM47282.1|Glycoside hydrolase, family 3, N-terminal: Glycoside hydrolase, family 3, C-terminal [*Clostridium thermocel* |
| 313, 314 | | 458aa long hypothetical endo-1;4-beta-glucanase [*Pyrococcus horikoshii* OT3] |
| 315, 316 | | Glycoside hydrolase, family 5 [*Clostridium thermocellum* ATCC 27405] gi|67850654|gb|EAM46228.1|Glycoside hydrolase, family 5 [*Clostridium thermocellum* ATCC 27405] gi|121821|sp|P23340|GUNC_CLOSF Endoglucanase C307 precursor (Endo-1,4-beta-glucanase) (Cellu |
| 317, 318 | | 458aa long hypothetical endo-1;4-beta-glucanase [*Pyrococcus horikoshii* OT3] |
| 319, 320 | β-glucosidase | Beta-glucosidase [*Clostridium thermocellum* ATCC 27405] gi|67851799|gb|EAM47362.1|Beta-glucosidase [*Clostridium thermocellum* ATCC 27405] |

| SEQ ID NO: | Activity Assignment | Exemplary function based on sequence identity (homology) (using BLAST) |
|---|---|---|
| 321, 322 | β-glucosidase | \|1W3J\|B Chain B; Family 1 B-Glucosidase From Thermotoga Maritima In Complex With Tetrahydrooxazine |
| 323, 324 | β-glucosidase | Glycoside hydrolase, family 1 [*Rhodoferax ferrireducens* DSM 15236] gi\|72603011\|gb\|EAO39027.1\|Glycoside hydrolase, family 1 [*Rhodoferax ferrireducens* DSM 15236] |
| 325, 326 | β-glucosidase | beta-glucosidase [*Thermotoga maritima*] |
| 327, 328 | β-glucosidase | beta-glucosidase [*Thermotoga maritima*] |
| 329, 330 | β-glucosidase | Beta-glucosidase [*Rhodobacter sphaeroides* ATCC 17029] gi\|83363682\|gb\|EAP67177.1\|Beta-glucosidase [*Rhodobacter sphaeroides* ATCC 17029] |
| 33, 34 | Cellobiohydrolase | GUXC_FUSOX exoglucanase type C precursor (Exocellobiohydrolase I) (1,4-beta-cellobiohydrolase) (Beta-glucancellobiohydrolase) [*Gibberella zeae* PH-1] gb\|AAO42612.2\|exoglucanase type C precursor [*Gibberella zeae*] ref\|XP_380747.1\|GUXC_FUSOX Putati |
| 331, 332 | β-glucosidase | cellulase [*Prevotella ruminicola*]. |
| 333, 334 | β-glucosidase | beta-glucosidase [*Thermotoga maritima*] |
| 335, 336 | β-glucosidase | Beta-glucosidase [*Clostridium* thermocellum ATCC 27405] gi\|67851799\|gb\|EAM47362.1\|Beta-glucosidase [*Clostridium* thermocellum ATCC 27405] |
| 337, 338 | | endoglucanase [*Thermotoga maritima* MSB8] |
| 339, 340 | β-glucosidase | beta-glucosidase [*Bradyrhizobium japonicum* USDA 110] |
| 341, 342 | β-glucosidase | Beta-glucosidase [*Thermoanaerobacter ethanolicus* ATCC 33223] gi\|76589196\|gb\|EAO65595.1\|Beta-glucosidase [*Thermoanaerobacter ethanolicus* ATCC 33223] |
| 343, 344 | β-glucosidase | endoglucanase [*Thermotoga maritima* MSB8] |
| 345, 346 | β-glucosidase | beta-glucosidase [*Bradyrhizobium japonicum* USDA 110] |
| 347, 348 | β-glucosidase | Glycoside hydrolase, family 1 [*Chloroflexus aurantiacus* J-10-fl] gi\|76164330\|gb\|EAO58481.1\|Glycoside hydrolase, family 1 [*Chloroflexus aurantiacus* J-10-fl] |
| 349, 350 | β-glucosidase | Beta-glucosidase [*Deinococcus geothermalis* DSM 11300] gi\|66780499\|gb\|EAL81486.1\|Beta-glucosidase [*Deinococcus geothermalis* DSM 11300] |
| 35, 36 | Cellobiohydrolase | cellobiohydrolase [*Trichoderma harzianum*] |
| 351, 352 | β-glucosidase | beta-glucosidase [*Bradyrhizobium japonicum* USDA 110] |
| 353, 354 | | NanG8 [*Streptomyces nanchangensis*]. |
| 355, 356 | β-glucosidase | Beta-glucosidase [*Deinococcus geothermalis* DSM 11300] gi\|66780499\|gb\|EAL81486.1\|Beta-glucosidase [*Deinococcus geothermalis* DSM 11300] |
| 357, 358 | β-glucosidase | beta-glucosidase [*Streptomyces coelicolor* A3(2)] |
| 359, 360 | | endoglucanase [*Thermotoga maritima* MSB8] |
| 361, 362 | β-glucosidase | 423aa long hypothetical beta-glucosidase [*Pyrococcus horikoshii* OT3] |
| 363, 364 | β-glucosidase | Beta-glucosidase [*Rubrobacter xylanophilus* DSM 9941] gi\|68512480\|gb\|EAN36288.1\|Beta-glucosidase [*Rubrobacter xylanophilus* DSM 9941] |
| 365, 366 | β-glucosidase | beta-glucosidase [*Thermus thermophilus* HB8] |
| 367, 368 | β-glucosidase | Beta-glucosidase/6-phospho-beta-glucosidase/beta-galactosidase [*Hahella chejuensis* KCTC 2396] |
| 369, 370 | β-glucosidase | COG1293: Predicted RNA-binding protein homologous to eukaryotic snRNP [*Cytophaga hutchinsonii*] |
| 37, 38 | Endoglucanase | probable cellulase [*Bradyrhizobium japonicum* USDA 110] |
| 371, 372 | | 458aa long hypothetical endo-1;4-beta-glucanase [*Pyrococcus horikoshii* OT3] |
| 373, 374 | β-glucosidase | Beta-glucosidase [*Burkholderia* sp. 383] |
| 375, 376 | β-glucosidase | beta-glucosidase [uncultured murine large bowel bacterium BAC 31B] |
| 377, 378 | β-glucosidase | beta-glucosidase [*Thermotoga maritima* MSB8] |
| 379, 380 | β-glucosidase | exo-1,4-beta-glucosidase [*Prevotella albensis*]. |
| 381, 382 | β-glucosidase | Glycoside hydrolase, family 3, N-terminal: Glycoside hydrolase, family 3, C-terminal [*Sphingopyxis alaskensis* RB2256] gi\|68524235\|gb\|EAN47359.1\|Glycoside hydrolase, family 3, N-terminal: Glycoside hydrolase, family 3, C-terminal [*Sphingopyxis alaskensis* RB |
| 383, 384 | β-glucosidase | beta-glucosidase [*Thermotoga maritima*] |
| 385, 386 | β-glucosidase | beta-glucosidase [*Bacteroides thetaiotaomicron* VPI-5482] |
| 387, 388 | β-glucosidase | Beta-glucosidase [*Thermoanaerobacter ethanolicus* ATCC 33223] gi\|76589196\|gb\|EAO65595.1\|Beta-glucosidase [*Thermoanaerobacter ethanolicus* ATCC 33223] |
| 389, 390 | β-glucosidase | Glycoside hydrolase, family 3, N-terminal: Glycoside hydrolase, family 3, C-terminal [*Chlorobium phaeobacteroides* BS1] gi\|67913451\|gb\|EAM62862.1\|Glycoside hydrolase, family 3, N-terminal: Glycoside hydrolase, family 3, C-terminal [*Chlorobium phaeobacteroid* |
| 39, 40 | Endoglucanase | \|LIC20191\|hypothetical protein LIC20191 [*Leptospira interrogans* serovar *Copenhageni* str. Fiocruz L1-130] |
| 391, 392 | β-glucosidase | beta-glucosidase [*Thermotoga maritima*] |
| 393, 394 | β-glucosidase | xylosidase/arabinosidase [*Colwellia psychrerythraea* 34H] |
| 395, 396 | β-glucosidase | beta-D-glucosidase [*Novosphingobium aromaticivorans* DSM 12444] gi\|78774097\|gb\|EAP37753.1\|beta-D-glucosidase [*Novosphingobium aromaticivorans* DSM 12444] |
| 397, 398 | β-glucosidase | \|1GON\|B Chain B; B-Glucosidase From *Streptomyces* Sp |
| 399, 400 | β-glucosidase | Beta-glucosidase [*Rubrobacter xylanophilus* DSM 9941] gi\|68512480\|gb\|EAN36288.1\|Beta-glucosidase [*Rubrobacter xylanophilus* DSM 9941] |
| 401, 402 | β-glucosidase | beta-glucosidase [uncultured murine large bowel bacterium BAC31B] |
| 403, 404 | β-glucosidase | glycosyl hydrolase; family 3 [*Enterococcus faecalis* V583] |
| 405, 406 | β-glucosidase | thermostable beta-glucosidase B [*Clostridium* beijerincki NCIMB 8052] gi\|82726826\|gb\|EAP61562.1\|thermostable beta-glucosidase B [*Clostridium* beijerincki NCIMB 8052] |
| 407, 408 | β-glucosidase | Beta-glucosidase [*Thermoanaerobacter ethanolicus* ATCC 33223] gi\|76589196\|gb\|EAO65595.1\|Beta-glucosidase [*Thermoanaerobacter ethanolicus* ATCC 33223] |
| 409, 410 | β-glucosidase | beta-glucosidase [*Thermotoga maritima*] |
| 41, 42 | B-glucosidase | beta-glucosidase [*Agrobacterium tumefaciens* str. C58 (U. Washington)]. |
| 411, 412 | β-glucosidase | 1;4-beta-D-glucan glucohydrolase [*Microbulbifer hydrolyticus*] |
| 413, 414 | β-glucosidase | Glycoside hydrolase, family 3, N-terminal: Glycoside hydrolase, family 3, C-terminal [*Sphingopyxis alaskensis* RB2256] gi\|68524235\|gb\|EAN47359.1\|Glycoside hydrolase, family 3, N-terminal: Glycoside hydrolase, family 3, C-terminal [*Sphingopyxis alaskensis* RB |
| 415, 416 | | cellulase [*Prevotella ruminicola*]. |

-continued

| SEQ ID NO: | Activity Assignment | Exemplary function based on sequence identity (homology) (using BLAST) |
|---|---|---|
| 417, 418 | β-glucosidase | Glycoside hydrolase, family 3, N-terminal: Glycoside hydrolase, family 3, C-terminal [*Sphingopyxis alaskensis* RB2256] gi|68524235|gb|EAN47359.1|Glycoside hydrolase, family 3, N-terminal: Glycoside hydrolase, family 3, C-terminal [*Sphingopyxis alaskensis* RB |
| 419, 420 | β-glucosidase | glucocerebrosidase [*Paenibacillus* sp. TS12]. |
| 421, 422 | β-glucosidase | 1,4-B-D-glucan glucohydrolase [*Pseudomonas fluorescens*]. |
| 423, 424 | β-glucosidase | Glycoside hydrolase, family 1 [*Solibacter usitatus* Ellin6076] gi|67858748|gb|EAM53848.1|Glycoside hydrolase, family 1 [*Solibacter usitatus* Ellin6076] |
| 425, 426 | β-glucosidase | N-acetyl-beta-glucosaminidase [*Cellulomonas fimi*]. |
| 427, 428 | | endoglucanase [*Thermotoga maritima* MSB8] |
| 429, 430 | | endoglucanase [*Thermotoga maritima* MSB8] |
| 43, 44 | Cellobiohydrolase | cellobiohydrolase II [*Acremonium cellulolyticus* Y-94]. |
| 431, 432 | β-glucosidase | Conserved hypothetical protein [*Novosphingobium aromaticivorans* DSM 12444] gi|78775241|gb|EAP38896.1|Conserved hypothetical protein [*Novosphingobium aromaticivorans* DSM 12444] |
| 433, 434 | PFAM:galactopyranose mutase | nucleotidyl-sugar pyranose mutase [*Campylobacter jejuni*] |
| 435, 436 | β-glucosidase | Beta-glucosidase [*Rhodobacter sphaeroides* ATCC 17029] gi|83363682|gb|EAP67177.1|Beta-glucosidase [*Rhodobacter sphaeroides* ATCC 17029] |
| 437, 438 | β-glucosidase | Beta-glucosidase [*Deinococcus geothermalis* DSM 11300] gi|66780499|gb|EAL81486.1|Beta-glucosidase [*Deinococcus geothermalis* DSM 11300] |
| 439, 440 | | IMP dehydrogenase/GMP reductase: Beta-lactamase [*Rhodopseudomonas palustris* BisA53] gi|77696568|gb|EAO87746.1|IMP dehydrogenase/GMP reductase: Beta-lactamase [*Rhodopseudomonas palustris* BisA53] |
| 441, 442 | | alpha-glucuronidase [*Thermotoga maritima*] |
| 443, 444 | | xylanase [*Microbulbifer hydrolyticus*] |
| 445, 446 | | exo-cellobiohydrolase [*Penicillium chrysogenum*] |
| 447, 448 | | extra-cellular xylanase [*Geobacillus stearothermophilus*] |
| 449, 450 | | hypothetical protein MG07908.4 [*Magnaporthe grisea* 70-15] |
| 45, 46 | Cellobiohydrolase | C-family cellulase homologue 2 |
| 451, 452 | | EXOGLUCANASE TYPE C PRECURSOR (EXOCELLOBIOHYDROLASE I) (1,4-BETA-CELLOBIOHYDROLASE) (BETA-GLUCANCELLOBIOHYDROLASE). |
| 453, 454 | | glycosyl hydrolase [*Clostridium* beijerincki NCIMB 8052] |
| 455, 456 | | alpha-L-arabinofuranosidase [*Clostridium stercorarium*]. |
| 457, 458 | | pectate lyase [uncultured bacterium] |
| 459, 460 | | Glycoside Hydrolase Family 51 [*Bacillus licheniformis* ATCC 14580] |
| 461, 462 | | alpha-L-arabinofuranosidase [*Bacillus subtilis*]. |
| 463, 464 | | alpha-L-arabinosidase; beta-xylosidase [*Bacillus subtilis* subsp. *subtilis* str. 168] |
| 465, 466 | | alpha-L-arabinofuranosidase [*Bacillus halodurans* C-125] |
| 467, 468 | | alpha-L-arabinofuranosidase [*Thermotoga maritima*] |
| 469, 470 | | alpha-L-arabinofuranosidase [*Geobacillus stearothermophilus*] |
| 47, 48 | Endoglucanase | cellulase [*Prevotella ruminicola*]. |
| 471, 472 | | alpha-L-arabinofuranosidase [*Geobacillus stearothermophilus*] |
| 473, 474 | | alpha-L-arabinofuranosidase [*Geobacillus stearothermophilus*] |
| 475, 476 | | alpha-L-arabinofuranosidase [*Streptomyces coelicolor* A3(2)] |
| 477, 478 | | alpha-L-arabinofuranosidase [*Geobacillus stearothermophilus*] |
| 479, 480 | | arabinase-TS [*Bacillus* sp. TS-3] |
| 481, 482 | | alpha-L-arabinofuranosidase [*Geobacillus stearothermophilus*] |
| 483, 484 | | Alpha-L-arabinofuranosidase [*Arthrobacter* sp. FB24] gi|66963675|ref|ZP_00411246.1|Alpha-L-arabinofuranosidase [*Arthrobacter* sp. FB24] |
| 485, 486 | | alpha-L-arabinofuranosidase [*Geobacillus stearothermophilus*] |
| 487, 488 | | alpha-L-arabinofuranosidase [*Geobacillus stearothermophilus*] |
| 489, 490 | | alpha-L-arabinofuranosidase [*Geobacillus stearothermophilus*] |
| 49, 50 | B-glucosidase | beta-glucosidase [*Bacillus* sp.]. |
| 491, 492 | | |GON|B Chain B; B-Glucosidase From *Streptomyces* Sp |
| 493, 494 | | xylosidase/arabinosidase [*Caulobacter crescentus* CB15] |
| 495, 496 | | XYLOSIDASE/ARABINOSIDASE [INCLUDES: BETA-XYLOSIDASE (1,4-BETA-D-XYLAN XYLOHYDROLASE) (XYLAN 1,4-BETA-XYLOSIDASE); ALPHA-L-ARABINOFURANOSIDASE (ARABINOSIDASE)]. |
| 497, 498 | | xylan beta-1;4-xylosidase [*Bacillus halodurans* C-125] |
| 499, 500 | | Glycoside hydrolase, family 3, N-terminal: Glycoside hydrolase, family 3, C-terminal [*Solibacter usitatus* Ellin6076] gi|67861669|gb|EAM56697.1|Glycoside hydrolase, family 3, N-terminal: Glycoside hydrolase, family 3, C-terminal [*Solibacter usitatus* Ellin60 |
| 5, 6 | B-glucosidase | beta-xylosidase B [*Clostridium stercorarium*]. |
| 501, 502 | | XYLOSIDASE/ARABINOSIDASE [INCLUDES: BETA-XYLOSIDASE (1,4-BETA-D-XYLAN XYLOHYDROLASE) (XYLAN 1,4-BETA-XYLOSIDASE); ALPHA-L-ARABINOFURANOSIDASE (ARABINOSIDASE)]. |
| 503, 504 | | XYLOSIDASE/ARABINOSIDASE [INCLUDES: BETA-XYLOSIDASE (1,4-BETA-D-XYLAN XYLOHYDROLASE) (XYLAN 1,4-BETA-XYLOSIDASE); ALPHA-L-ARABINOFURANOSIDASE (ARABINOSIDASE)]. |
| 505, 506 | | XYLOSIDASE/ARABINOSIDASE [INCLUDES: BETA-XYLOSIDASE (1,4-BETA-D-XYLAN XYLOHYDROLASE) (XYLAN 1,4-BETA-XYLOSIDASE); ALPHA-L-ARABINOFURANOSIDASE (ARABINOSIDASE)]. |
| 507, 508 | | pectate lyase [uncultured bacterium] |
| 509, 510 | | pectate lyase [uncultured bacterium] |
| 51, 52 | Cellobiohydrolase | exo-cellobiohydrolase 1 [*Penicillium janthinellum*] |
| 511, 512 | | pectate lyase [uncultured bacterium] |

-continued

| SEQ ID NO: | Activity Assignment | Exemplary function based on sequence identity (homology) (using BLAST) |
|---|---|---|
| 513, 514 | | pectate lyase [uncultured bacterium] |
| 515, 516 | | hypothetical protein [*Neurospora crassa*] |
| 517, 518 | | PehC [*Ralstonia solanacearum*]. |
| 53, 54 | Cellobiohydrolase | cellobiohydrolase 1 [*Penicillium occitanis*] |
| 519, 520 | Oligomerase | hypothetical protein SNOG_08993 [*Phaeosphaeria nodorum* SN15] |
| 521, 522 | Oligomerase | beta-glucosidase [*Phaeosphaeria avenaria* f. sp. *triticae*] |
| 523, 524 | xylanase | endo-1;4-beta-xylanase precursor [uncultured bacterium] |
| 55, 56 | Cellobiohydrolase | exoglucanase [*Alternaria alternata*]. |
| 57, 58 | B-glucosidase | glucan 1,4-beta-glucosidase (EC 3.2.1.74)-*Pseudomonas fluorescens* subap. *cellulosa*. |
| 59, 60 | Cellobiohydrolase | \|A38979\|cellulose 1;4-beta-cellobiosidase (EC 3.2.1.91) II-fungus (*Trichoderma viride*) |
| 61, 62 | Endoglucanase | cellodextrinase. |
| 63, 64 | Cellobiohydrolase | hypothetical protein MG04499.4 [*Magnaporthe grisea* 70-15] ref\|XP_362054.1\|hypothetical protein MG04499.4 [*Magnaporthe grisea* 70-15] |
| 65, 66 | Cellobiohydrolase | cellobiohydrolase II [*Trichoderma parceramosum*] |
| 67, 68 | Cellobiohydrolase | cellobiohydrolase II [*Talaromyces emersonii*]. |
| 69, 70 | B-glucosidase | beta-glucosidase [*Methylococcus capsulatus* str. Bath] gb\|AAU92142.1\|beta-glucosidase [*Methylococcus capsulatus* str. Bath] |
| 7, 8 | B-glucosidase | beta-glucosidase [*Bacteroides fragilis* YCH46] |
| 71, 72 | Cellobiohydrolase | cellobiohydrolase II [*Talaromyces emersonii*]. |
| 73, 74 | Cellobiohydrolase | cellulase CEL2 [*Leptosphaeria maculans*]. |
| 75, 76 | B-glucosidase | beta-glucosidase [*Bradyrhizobium japonicum* USDA 110] |
| 77, 78 | Cellobiohydrolase | cellobiohydrolase 1 catalytic domain [*Talaromyces emersonii*] |
| 79, 80 | B-glucosidase | beta-mannosidase [*Pyrococcus furiosus* DSM 3638]. |
| 81, 82 | Cellobiohydrolase | cellobiohydrolase II [*Talaromyces emersonii*]. |
| 83, 84 | Cellobiohydrolase | cellobiohydrolase D [*Aspergillus oryzae*]. |
| 85, 86 | Endoglucanase | cellulase [*Prevotella ruminicola*]. |
| 87, 88 | Cellobiohydrolase | hypothetical protein MG07809.4 [*Magnaporthe grisea* 70-15] ref\|XP_367905.1\|hypothetical protein MG07809.4 [*Magnaporthe grisea* 70-15] |
| 89, 90 | B-glucosidase | beta-D-glucosidase [*Caulobacter crescentus*]. |
| 9, 10 | Cellobiohydrolase | cellobiohydrolase 1 [*Penicillium occitanis*] |
| 91, 92 | | alpha-L-arabinofuranosidase ArfA [*Clostridium cellulovorans*]. |
| 93, 94 | B-glucosidase | Beta-glucosidase [*Thermoanaerobacter ethanolicus* ATCC 33223] gi\|76589196\|gb\|EAO65595.1\|Beta-glucosidase [*Thermoanaerobacter ethanolicus* ATCC 33223] |
| 95, 96 | | beta-xylosidase [*Geobacillus stearothermophilus*]. |
| 97, 98 | | hypothetical protein AN5282.2 [*Aspergillus nidulans* FGSC A4] |
| 99, 100 | | beta-1,4-xylanase [*Pseudomonas* sp. ND137]. |

Oligomerases

The invention also provides polypeptides of the invention having oligomerase enzymatic activity, e.g., an oligomerase-1 (a β-glucosidase) or an oligomerase-2 (a β-xylosidase), or able to catalyze the hydrolysis of (degrade) soluble cellooligsaccharides and/or arabinoxylan oligomers into monomers, such as xylose, arabinose and glucose. For example, the exemplary polypeptides of the invention SEQ ID NO:522 (encoded, e.g., by SEQ ID NO:521) and SEQ ID NO:520 (encoded, e.g., by SEQ ID NO:519) have oligomerase enzymatic activity. gpe During the enzymatic hydrolysis of hemicellulose and cellulose in biomass (e.g. alkaline pretreated corn biomass), the insoluble polymeric substrates are first converted into soluble oligomers such as arabinoxylooligosaccharides and cellooligosaccharides and these soluble oligomers can be further degraded to fermentable, monomeric sugars by oligomerase polypeptides of the invention, e.g., SEQ ID NO:522 (encoded, e.g., by SEQ ID NO:521) and SEQ ID NO:520 (encoded, e.g., by SEQ ID NO:519). Thus, the invention also provides methods for "converting" arabinoxylo-oligosaccharides and cellooligosaccharides to monomeric sugars (e.g., fermentable, monomeric sugars, such as xylose, arabinose and glucose. The invention also provides methods for treating biomass, e.g., corn, such as alkaline pretreated corn biomass, to "convert" the biomass to fermentable, monomeric sugars using one or any combination of enzymes of the invention, including one or more of the polypeptides of the invention having oligomerase enzymatic activity.

In alternative aspect, enzymes of the invention are combined together in various combinations, or are combined with other oligomerases, cellulases and/or hemicellulases to form enzyme cocktails that enable the conversion of plant biomass (e.g., corn, grasses) to fermentable monomeric sugars, such as xylose, arabinose and glucose. A representative enzyme cocktail is listed below:

| Enzyme | Class | Usage (mg/g cellulose) |
|---|---|---|
| SEQ ID NO: 106 (encoded, e.g., by SEQ ID NO: 105) | Endoglucanase | 1.7 |
| SEQ ID NO: 34 (encoded, e.g., by SEQ ID NO: 33) | GH 7 cellobiohydrolase | 1 |
| SEQ ID NO: 98 (encoded, e.g., by SEQ ID NO: 97) | GH 6 cellobiohydrolase | 5 |
| SEQ ID NO: 94 (encoded, e.g., by SEQ ID NO: 93) | β-glucosidase | 1.3 |
| SEQ ID NO: 100 (encoded, e.g., by SEQ ID NO: 99) | GH11 endoxylanase | 0.6 |
| SEQ ID NO: 102 (encoded, e.g., by SEQ ID NO: 101) | GH10 endoxylanase | 0.2 |
| SEQ ID NO: 96 (encoded, e.g., by SEQ ID NO: 95) | β-xylosidase | 0.5 |
| SEQ ID NO: 92 (encoded, e.g., by SEQ ID NO: 91) | Arabinofuranosidase | 0.3 |
| SEQ ID NO: 520 (encoded, e.g., by SEQ ID NO: 519) | GH 3 oligomerase | 0.5 |
| SEQ ID NO: 522 (encoded, e.g., by SEQ ID NO: 521) | GH 3 oligomerase | 0.5 |

Figure 121:
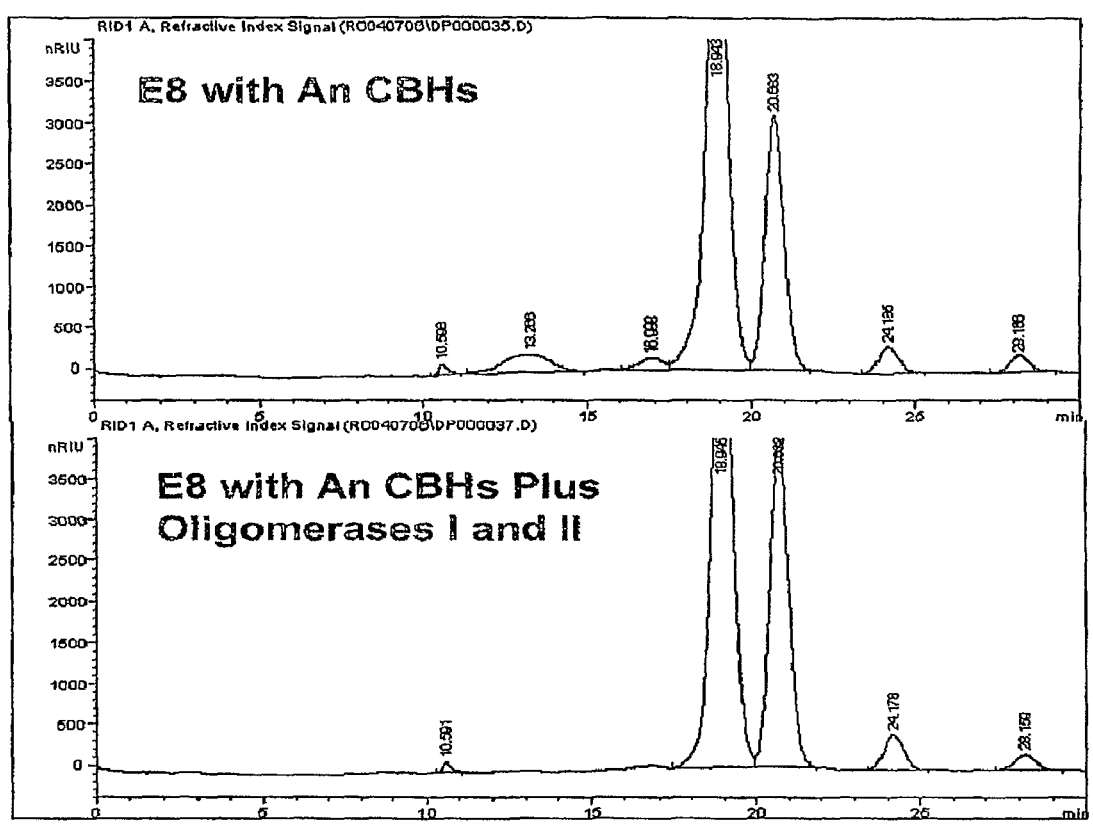
FIG. 121 illustrates time course studies of polysaccharide hydrolysis reactions using exemplary enzyme cocktails of the invention, as discussed in detail, below.

FIG. 121 illustrates HPLC traces of two saccharification reaction products (at 48 hr of incubation), these data demonstrating the role oligomerases (and in this study, oligomerases of this invention) play in the degradation of soluble oligomeric saccharides. Peaks at 13 and 16 minutes are soluble oligomeric arabinoxyan and cellooligosaccharides, respectively. In FIG. 121, the top panel illustrates an HPLC trace of a saccharification reaction using a "cocktail" designated "E8" with no oligomerases (the first eight enzymes noted above, or, endoglucanase, GH 7 cellobiohydrolase, GH 6 cellobiohydrolase, β-glucosidase and an arabinofuranosidase). Thus, the invention provides compositions comprising the "cocktail" comprising an endoglucanase, a GH 7 cellobiohydrolase, a GH 6 cellobiohydrolase, a β-glucosidase and an arabinofuranosidase, and in one aspect, at least one, several or all are enzymes of this invention, e.g., an exemplary enzymes of this invention, e.g., SEQ ID NO:106 (encoded, e.g., by SEQ ID NO:105), SEQ ID NO:34 (encoded, e.g., by SEQ ID NO:33), SEQ ID NO:98 (encoded, e.g., by SEQ ID NO:97), SEQ ID NO:94 (encoded, e.g., by SEQ ID NO:93), SEQ ID NO:100 (encoded, e.g., by SEQ ID NO:99), SEQ ID NO:102 (encoded, e.g., by SEQ ID NO:101), SEQ ID NO:96 (encoded, e.g., by SEQ ID NO:95), and/or SEQ ID NO:92 (encoded, e.g., by SEQ ID NO:91).

Figure 122A:
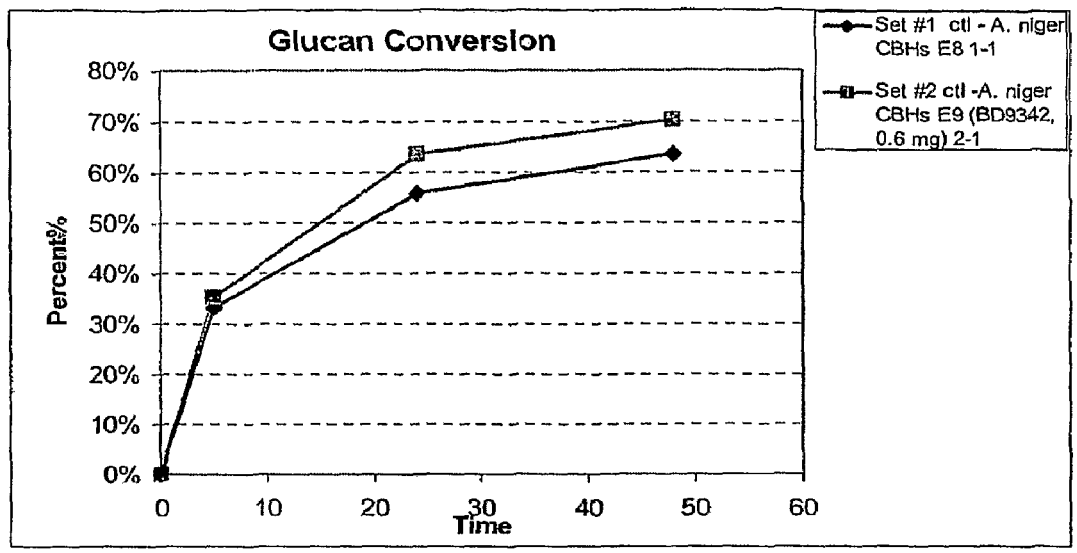
FIGS. 122A and 122B, illustrate time course studies of polysaccharide hydrolysis reactions using exemplary enzyme cocktails of the invention, as discussed in detail, below.
Figure 122:
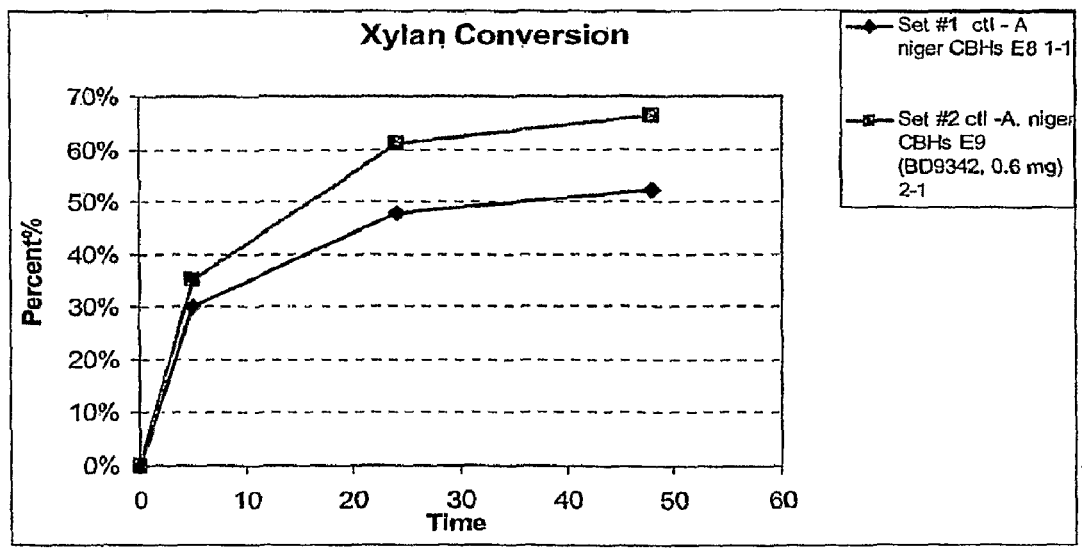

In FIG. 121, the bottom panel illustrates an HPLC trace of a saccharification reaction using a "cocktail" comprising this "E8" cocktail plus two oligomerases I and II, as noted above (these exemplary enzymes of the invention are SEQ ID NO:520 (encoded, e.g., by SEQ ID NO:519) and SEQ ID NO:522 (encoded, e.g., by SEQ ID NO:521)). These data clearly demonstrate that addition of these exemplary oligomerase enzymes of the invention decrease the levels of oligomeric arabinoxyan and cellooligosaccharides and increase the amount of monomeric (fermentable) sugars). Thus, the invention provides compositions comprising the "cocktail" comprising "cocktails" of cellulose degrading enzymes, such as the exemplary "E8" mixture noted above, and an oligomerase, and in one aspect, at least one or several oligomerase enzymes of this invention, e.g., the exemplary SEQ ID NO:520 (encoded, e.g., by SEQ ID NO:519) and SEQ ID NO:522 (encoded, e.g., by SEQ ID NO:521) enzymes of this invention Oligomerase II (the exemplary SEQ ID NO:520 (encoded, e.g., by SEQ ID NO:519)), when dosed at 1 mg/g of cellulose, increased both xylose (from 52% to 66%) and glucose (from 63% to 70%) yields compared to a cocktail without the exemplary SEQ ID NO:520 (encoded, e.g., by SEQ ID NO:519). FIG. 122 illustrates time course studies of the reactions with enzyme cocktails E8 (as defined above, as "set-1" in FIG. 122A) and E8 plus an oligomerase II, the exemplary SEQ ID NO:520 (encoded, e.g., by SEQ ID NO:519) (the so-called "E9" cocktail mixture, or "set-2" in FIG. 122B). In FIG. 122A, the top panel illustrates time course studies for glucose yields; and in FIG. 122B, and the bottom panel illustrates time course studies for xylose yields.

Additional experiments demonstrated that oligomerase I (the exemplary SEQ ID NO:522 (encoded, e.g., by SEQ ID NO:521)) was capable of degrading both cellobiose and other cellooligosaccharides, thus rendering the exemplary β-glucosidase SEQ ID NO:94 (encoded, e.g., by SEQ ID NO:93) unnecessary in the cocktail. Thus, another exemplary enzyme cocktail of the invention comprises the exemplary SEQ ID NO:106 (encoded, e.g., by SEQ ID NO:105), SEQ ID NO:34 (encoded, e.g., by SEQ ID NO:33), SEQ ID NO:98 (encoded, e.g., by SEQ ID NO:97), SEQ ID NO:94 (encoded, e.g., by SEQ ID NO:93), SEQ ID NO:100 (encoded, e.g., by SEQ ID NO:99), SEQ ID NO:102 (encoded, e.g., by SEQ ID NO:101), SEQ ID NO:96 (encoded, e.g., by SEQ ID NO:95), SEQ ID NO:92 (encoded, e.g., by SEQ ID NO:91) and SEQ ID NO:522 (encoded, e.g., by SEQ ID NO:521); or, the exemplary SEQ ID NO:106 (encoded, e.g., by SEQ ID NO:105), SEQ ID NO:34 (encoded, e.g., by SEQ ID NO:33), SEQ ID NO:98 (encoded, e.g., by SEQ ID NO:97), SEQ ID NO:100 (encoded, e.g., by SEQ ID NO:99), SEQ ID NO:102 (encoded, e.g., by SEQ ID NO:101), SEQ ID NO:96 (encoded, e.g., by SEQ ID NO:95), SEQ ID NO:92 (encoded, e.g., by SEQ ID NO:91) and SEQ ID NO:520 (encoded, e.g., by SEQ ID NO:519) (or SEQ ID NO:522 (encoded, e.g., by SEQ ID NO:521)).

Similarly, oligomerase II (the exemplary SEQ ID NO:520 (encoded, e.g., by SEQ ID NO:519)) was also capable of degrading both xylobiose and other soluble arabinoxylan by replacing the exemplary β-xylosidase SEQ ID NO:96 (encoded, e.g., by SEQ ID NO:95) in the cocktail. Thus, another exemplary enzyme cocktail of the invention comprises SEQ ID NO:106 (encoded, e.g., by SEQ ID NO:105), SEQ ID NO:34 (encoded, e.g., by SEQ ID NO:33), SEQ ID NO:98 (encoded, e.g., by SEQ ID NO:97), SEQ ID NO:94 (encoded, e.g., by SEQ ID NO:93), SEQ ID NO:100 (encoded, e.g., by SEQ ID NO:99), SEQ ID NO:102 (encoded, e.g., by SEQ ID NO:101), SEQ ID NO:96 (encoded, e.g., by SEQ ID NO:95), SEQ ID NO:92 (encoded, e.g., by SEQ ID NO:91) and SEQ ID NO:520 (encoded, e.g., by SEQ ID NO:519); or, SEQ ID NO:106 (encoded, e.g., by SEQ ID NO:105), SEQ ID NO:34 (encoded, e.g., by SEQ ID NO:33), SEQ ID NO:98 (encoded, e.g., by SEQ ID NO:97), SEQ ID NO:94 (encoded, e.g., by SEQ ID NO:93), SEQ ID NO:100 (encoded, e.g., by SEQ ID NO:99), SEQ ID NO:102 (encoded, e.g., by SEQ ID NO:101), SEQ ID NO:92 (encoded, e.g., by SEQ ID NO:91) and SEQ ID NO:520 (encoded, e.g., by SEQ ID NO:519) (or SEQ ID NO:522 (encoded, e.g., by SEQ ID NO:521)).

In alternative aspects, individual enzymes of the invention, or combinations (or "cocktails" or mixtures) of enzymes of the invention (which can comprise one or several non-invention enzymes) can be used to process (degrade) commercial cellulase preparations, e.g., those derived from crude fungal culture broths, such as *Trichoderma reesei*. The enzymes of the invention are added because the commercial preparations alone are deficient in many enzyme activities, e.g. hemicellulase activity, which are required to digest alkaline pretreated biomass. More importantly, enzymes of the invention are added because the majority of solubilized xylan in commercial cellulase preparations exist in oligomeric forms which, without addition of enzymes of the invention, would be resistant to further degradation to monomer sugars. Thus, the invention provides enzyme solutions to recalcitrant soluble xylooligomers, e.g., those found in commercial cellulase preparations such as those derived from crude fungal culture broths. The invention also provides enzyme solutions to degrading soluble cellooligosaccharides, although their ratio to glucose monomer is generally smaller. In one aspect, the oligomerases of this invention allow the breakdown of recalcitrant cellooligosaccharides and arabinoxylooligomers into fermentable, monomeric sugars such as glucose, xylose and arabinose.

In one aspect, enzymes of the invention, including the "cocktail" enzyme mixtures of this invention, increase the overall conversion of hemicellulose and cellulose to monomeric sugar from a biomass, e.g., a corn- or grass-comprising biomass. Without the addition of the oligomerases of this invention a large amount of xylose remains tied up in non-fermentable oligosaccharides. Furthermore, these oligomerase enzymes of this invention can be used to replace and/or supplement other enzymes in a cocktail, for example, beta-glucosidase and/or beta-xylosidase, thereby not increasing the overall protein loading. These two exemplary oligomerases of this invention enzymes have been demonstrated to be multi-functional in that they have relaxed substrate specificities, as discussed above (and see also FIGS. 121 and 122).

Assays for Determining or Characterizing the Activity of an Enzyme

Assays for determining or characterizing the activity of an enzyme, such as determining oligomerase, cellulase, xylanase, cellobiohydrolase, β-glucosidase, β-xylosidase, arabinofuranosidase or related activity, e.g., to determine if a polypeptide is within the scope of the invention, are well known in the art, for example, see Thomas M. Wood, K. Mahalingeshwara Bhat, "Methods for Measuring Cellulase Activities", *Methods in Enzymology*, 160, 87-111 (1988); U.S. Pat. Nos. 5,747,320; 5,795,766; 5,973,228; 6,022,725; 6,087,131; 6,127,160; 6,184,018; 6,423,524; 6,566,113; 6,921,655.

In some aspects, a polypeptide of the invention can have an alternative enzymatic activity. For example, the polypeptide can have endoglucanase/cellulase activity; xylanase activity; protease activity; etc.; in other words, enzymes of the invention can be multi-functional in that they have relaxed substrate specificities. In fact, studies shown herein demonstrate that two exemplary oligomerases of this invention enzymes are multi-functional in that they have relaxed substrate specificities, see discussion above.

"Amino acid" or "amino acid sequence" as used herein refer to an oligopeptide, peptide, polypeptide, or protein sequence, or to a fragment, portion, or subunit of any of these and to naturally occurring or synthetic molecules. "Amino acid" or "amino acid sequence" include an oligopeptide, peptide, polypeptide, or protein sequence, or to a fragment, portion, or subunit of any of these, and to naturally occurring or synthetic molecules. The term "polypeptide" as used herein, refers to amino acids joined to each other by peptide bonds or modified peptide bonds, i.e., peptide isosteres and may contain modified amino acids other than the 20 gene-encoded amino acids. The polypeptides may be modified by either natural processes, such as post-translational processing, or by chemical modification techniques which are well known in the art. Modifications can occur anywhere in the polypeptide, including the peptide backbone, the amino acid side-chains and the amino or carboxyl termini. It will be appreciated that the same type of modification may be present in the same or varying degrees at several sites in a given polypeptide. Also a given polypeptide may have many types of modifications. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of a phosphatidylinositol, cross-linking cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristolyation, oxidation, pegylation, glucan hydrolase processing, phosphorylation, prenylation, racemization, selenoylation, sulfation and transfer-RNA mediated addition of amino acids to protein such as arginylation. (See Creighton, T. E., Proteins—Structure and Molecular Properties 2nd Ed., W.H. Freeman and Company, New York (1993); *Posttranslational Covalent Modification of Proteins*, B. C. Johnson, Ed., Academic Press, New York, pp. 1-12 (1983)). The peptides and polypeptides of the invention also include all "mimetic" and "peptidomimetic" forms, as described in further detail, below.

As used herein, the term "isolated" means that the material (e.g., a protein or nucleic acid of the invention) is removed from its original environment (e.g., the natural environment if it is naturally occurring). For example, a naturally-occurring polynucleotide or polypeptide present in a living animal is not isolated, but the same polynucleotide or polypeptide, separated from some or all of the coexisting materials in the natural system, is isolated. Such polynucleotides could be part of a vector and/or such polynucleotides or polypeptides could be part of a composition and still be isolated in that such vector or composition is not part of its natural environment. As used herein, the term "purified" does not require absolute purity; rather, it is intended as a relative definition. Individual nucleic acids obtained from a library have been conventionally purified to electrophoretic homogeneity. The sequences obtained from these clones could not be obtained directly either from the library or from total human DNA. The purified nucleic acids of the invention have been purified from the remainder of the genomic DNA in the organism by at least $10^4$-$10^6$ fold. In one aspect, the term "purified" includes nucleic acids which have been purified from the remainder of the genomic DNA or from other sequences in a library or other environment by at least one order of magnitude, e.g., in one aspect, two or three orders, or, four or five orders of magnitude.

"Recombinant" polypeptides or proteins refer to polypeptides or proteins produced by recombinant DNA techniques; i.e., produced from cells transformed by an exogenous DNA construct encoding the desired polypeptide or protein. "Synthetic" polypeptides or protein are those prepared by chemical synthesis. Solid-phase chemical peptide synthesis methods can also be used to synthesize the polypeptide or fragments of the invention. Such method have been known in the art since the early 1960's (Merrifield, R. B., *J. Am. Chem. Soc.*, 85:2149-2154, 1963) (See also Stewart, J. M. and Young, J. D., Solid Phase Peptide Synthesis, 2nd Ed., Pierce Chemical Co., Rockford, Ill., pp. 11-12)) and have recently been employed in commercially available laboratory peptide design and synthesis kits (Cambridge Research Biochemicals). Such commercially available laboratory kits have generally utilized the teachings of H. M. Geysen et al., *Proc. Natl. Acad. Sci., USA*, 81:3998 (1984) and provide for synthesizing peptides upon the tips of a multitude of "rods" or "pins" all of which are connected to a single plate.

The phrase "substantially identical" in the context of two nucleic acids or polypeptides, refers to two or more sequences that have, e.g., at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more nucleotide or amino acid residue (sequence) identity, when compared and aligned for maximum correspondence, as measured using one of the known sequence comparison algorithms or by visual inspection. In alternative aspects, the substantial identity exists over a region of at least about 100 or more residues and most commonly the sequences are substantially identical over at least about 150 to 200 or more residues. In some aspects, the sequences are substantially identical over the entire length of the coding regions.

Additionally a "substantially identical" amino acid sequence is a sequence that differs from a reference sequence by one or more conservative or non-conservative amino acid substitutions, deletions, or insertions. In one aspect, the substitution occurs at a site that is not the active site of the molecule, or, alternatively the substitution occurs at a site that is the active site of the molecule, provided that the polypeptide essentially retains its functional (enzymatic) properties. A conservative amino acid substitution, for example, substitutes one amino acid for another of the same class (e.g., substitution of one hydrophobic amino acid, such as isoleucine, valine, leucine, or methionine, for another, or substitution of one polar amino acid for another, such as substitution of arginine for lysine, glutamic acid for aspartic acid or glutamine for asparagine). One or more amino acids can be deleted, for example, from a cellulase, e.g., endoglucanase, cellobiohydrolase, beta-glucosidase, xylanase, mannanse, β-xylosidase, arabinofuranosidase, and/or oligomerase polypeptide, resulting in modification of the structure of the polypeptide, without significantly altering its biological activity. For example, amino- or carboxyl-terminal amino acids that are not required for cellulase, e.g., endoglucanase, cellobiohydrolase, beta-glucosidase, xylanase, mannanse, β-xylosidase, arabinofuranosidase, and/or oligomerase enzyme biological activity can be removed. Modified polypeptide sequences of the invention can be assayed for cellulase, e.g., endoglucanase, cellobiohydrolase, beta-glucosidase, xylanase, mannanse, β-xylosidase, arabinofuranosidase, and/or oligomerase enzyme biological activity by any number of methods, including contacting the modified polypeptide sequence with a substrate and determining whether the modified polypeptide decreases the amount of specific substrate in the assay or increases the bioproducts of the enzymatic reaction of a functional cellulase, e.g., endoglucanase, cellobiohydrolase, beta-glucosidase, xylanase, mannanse, β-xylosidase, arabinofuranosidase, and/or oligomerase polypeptide with the substrate.

"Fragments" as used herein are a portion of a naturally occurring protein which can exist in at least two different conformations. Fragments can have the same or substantially the same amino acid sequence as the naturally occurring protein. Fragments which have different three dimensional structures as the naturally occurring protein are also included. An example of this, is a "pro-form" molecule, such as a low activity proprotein that can be modified by cleavage to produce a mature enzyme with significantly higher activity.

In one aspect, the invention provides crystal (three-dimensional) structures of proteins and peptides, e.g., cellulases, of the invention; which can be made and analyzed using the routine protocols well known in the art, e.g., as described in MacKenzie (1998) Crystal structure of the family 7 endoglucanase I (Cel7B) from *Humicola insolens* at 2.2 A resolution and identification of the catalytic nucleophile by trapping of the covalent glycosyl-enzyme intermediate, Biochem. J. 335: 409-416; Sakon (1997) Structure and mechanism of endo/exocellulase E4 from *Thermomonospora fusca*, Nat. Struct. Biol 4:810-818; Varrot (1999) Crystal structure of the catalytic core domain of the family 6 cellobiohydrolase II, Cel6A, from *Humicola insolens*, at 1.92 A resolution, Biochem. J. 337:297-304; illustrating and identifying specific structural elements as guidance for the routine generation of cellulase variants of the invention, and as guidance for identifying enzyme species within the scope of the invention.

Polypeptides and peptides of the invention can be isolated from natural sources, be synthetic, or be recombinantly generated polypeptides. Peptides and proteins can be recombinantly expressed in vitro or in vivo. The peptides and polypeptides of the invention can be made and isolated using any method known in the art. Polypeptide and peptides of the invention can also be synthesized, whole or in part, using chemical methods well known in the art. See e.g., Caruthers (1980) Nucleic Acids Res. Symp. Ser. 215-223; Horn (1980) Nucleic Acids Res. Symp. Ser. 225-232; Banga, A. K., Therapeutic Peptides and Proteins, Formulation, Processing and Delivery Systems (1995) Technomic Publishing Co., Lancaster, Pa. For example, peptide synthesis can be performed using various solid-phase techniques (see e.g., Roberge (1995) Science 269:202; Merrifield (1997) Methods Enzymol. 289:3-13) and automated synthesis may be achieved, e.g., using the ABI 431A Peptide Synthesizer (Perkin Elmer) in accordance with the instructions provided by the manufacturer.

The peptides and polypeptides of the invention can also be glycosylated. The glycosylation can be added post-translationally either chemically or by cellular biosynthetic mechanisms, wherein the later incorporates the use of known glycosylation motifs, which can be native to the sequence or can be added as a peptide or added in the nucleic acid coding sequence. The glycosylation can be O-linked or N-linked.

The peptides and polypeptides of the invention, as defined above, include all "mimetic" and "peptidomimetic" forms. The terms "mimetic" and "peptidomimetic" refer to a synthetic chemical compound which has substantially the same structural and/or functional characteristics of the polypeptides of the invention. The mimetic can be either entirely composed of synthetic, non-natural analogues of amino acids, or, is a chimeric molecule of partly natural peptide amino acids and partly non-natural analogs of amino acids. The mimetic can also incorporate any amount of natural amino acid conservative substitutions as long as such substitutions also do not substantially alter the mimetic's structure and/or activity. As with polypeptides of the invention which are conservative variants or members of a genus of polypeptides of the invention (e.g., having about 50% or more sequence identity to an exemplary sequence of the invention), routine experimentation will determine whether a mimetic is within the scope of the invention, i.e., that its structure and/or function is not substantially altered. Thus, in one aspect, a mimetic composition is within the scope of the invention if it has a cellulase, e.g., endoglucanase, cellobiohydrolase, beta-glucosidase, xylanase, mannanse, β-xylosidase, arabinofuranosidase, and/or oligomerase enzymes activity.

Polypeptide mimetic compositions of the invention can contain any combination of non-natural structural components. In alternative aspect, mimetic compositions of the invention include one or all of the following three structural groups: a) residue linkage groups other than the natural amide bond ("peptide bond") linkages; b) non-natural residues in place of naturally occurring amino acid residues; or c) residues which induce secondary structural mimicry, i.e., to induce or stabilize a secondary structure, e.g., a beta turn, gamma turn, beta sheet, alpha helix conformation, and the like. For example, a polypeptide of the invention can be characterized as a mimetic when all or some of its residues are joined by chemical means other than natural peptide bonds. Individual peptidomimetic residues can be joined by peptide bonds, other chemical bonds or coupling means, such as, e.g., glutaraldehyde, N-hydroxysuccinimide esters, bifunctional maleimides, N,N'-dicyclohexylcarbodiimide (DCC) or N,N'-diisopropylcarbodiimide (DIC). Linking groups that can be an alternative to the traditional amide bond ("peptide bond") linkages include, e.g., ketomethylene (e.g., —C(=O)—CH$_2$— for —C(=O)—NH—), aminomethylene (CH$_2$—NH), ethylene, olefin (CH=CH), ether (CH$_2$—O), thioether (CH$_2$—S), tetrazole (CN$_4$—), thiazole, retroamide, thioamide, or ester (see, e.g., Spatola (1983) in Chemistry and Biochemistry of Amino Acids, Peptides and Proteins, Vol. 7, pp 267-357, "Peptide Backbone Modifications," Marcell Dekker, NY).

A polypeptide of the invention can also be characterized as a mimetic by containing all or some non-natural residues in place of naturally occurring amino acid residues. Non-natural residues are well described in the scientific and patent literature; a few exemplary non-natural compositions useful as mimetics of natural amino acid residues and guidelines are described below. Mimetics of aromatic amino acids can be generated by replacing by, e.g., D- or L-naphylalanine; D- or L-phenylglycine; D- or L-2 thieneylalanine; D- or L-1,-2,3-, or 4-pyreneylalanine; D- or L-3 thieneylalanine; D- or L-(2-pyridinyl)-alanine; D- or L-(3-pyridinyl)-alanine; D- or L-(2-pyrazinyl)-alanine; D- or L-(4-isopropyl)-phenylglycine; D-(trifluoromethyl)-phenylglycine; D-(trifluoromethyl)-phenylalanine; D-p-fluoro-phenylalanine; D- or L-p-biphenylphenylalanine; D- or L-p-methoxy-biphenylphenylalanine; D- or L-2-indole(alkyl)alanines; and, D- or L-alkylainines, where alkyl can be substituted or unsubstituted methyl, ethyl, propyl, hexyl, butyl, pentyl, isopropyl, iso-butyl, sec-isotyl, iso-pentyl, or a non-acidic amino acids. Aromatic rings of a non-natural amino acid include, e.g., thiazolyl, thiophenyl, pyrazolyl, benzimidazolyl, naphthyl, furanyl, pyrrolyl, and pyridyl aromatic rings.

Mimetics of acidic amino acids can be generated by substitution by, e.g., non-carboxylate amino acids while maintaining a negative charge; (phosphono)alanine; sulfated threonine. Carboxyl side groups (e.g., aspartyl or glutamyl) can also be selectively modified by reaction with carbodiimides (R'—N—C—N—R') such as, e.g., 1-cyclohexyl-3(2-morpholinyl-(4-ethyl) carbodiimide or 1-ethyl-3(4-azonia-4, 4-dimetholpentyl) carbodiimide. Aspartyl or glutamyl can also be converted to asparaginyl and glutaminyl residues by reaction with ammonium ions. Mimetics of basic amino acids can be generated by substitution with, e.g., (in addition to lysine and arginine) the amino acids ornithine, citrulline, or (guanidino)-acetic acid, or (guanidino)alkyl-acetic acid, where alkyl is defined above. Nitrile derivative (e.g., containing the CN-moiety in place of COOH) can be substituted for asparagine or glutamine. Asparaginyl and glutaminyl residues can be deaminated to the corresponding aspartyl or glutamyl residues. Arginine residue mimetics can be generated by reacting arginyl with, e.g., one or more conventional reagents, including, e.g., phenylglyoxal, 2,3-butanedione, 1,2-cyclo-hexanedione, or ninhydrin, in one aspect under alkaline conditions. Tyrosine residue mimetics can be generated by reacting tyrosyl with, e.g., aromatic diazonium compounds or tetranitromethane. N-acetylimidizol and tetranitromethane can be used to form O-acetyl tyrosyl species and 3-nitro derivatives, respectively. Cysteine residue mimetics can be generated by reacting cystinyl residues with, e.g., alpha-haloacetates such as 2-chloroacetic acid or chloroacetamide and corresponding amines; to give carboxymethyl or carboxyamidomethyl derivatives. Cysteine residue mimetics can also be generated by reacting cystinyl residues with, e.g., bromo-trifluoroacetone, alpha-bromo-beta-(5-imidozoyl) propionic acid; chloroacetyl phosphate, N-alkylmaleimides, 3-nitro-2-pyridyl disulfide; methyl 2-pyridyl disulfide; p-chloromercuribenzoate; 2-chloromercuri-4 nitrophenol; or, chloro-7-nitrobenzo-oxa-1,3-diazole. Lysine mimetics can be generated (and amino terminal residues can be altered) by reacting lysinyl with, e.g., succinic or other carboxylic acid anhydrides. Lysine and other alpha-amino-containing residue mimetics can also be generated by reaction with imidoesters, such as methyl picolinimidate, pyridoxal phosphate, pyridoxal, chloroborohydride, trinitro-benzene-sulfonic acid, O-methylisourea, 2,4, pentanedione, and transamidase-catalyzed reactions with glyoxylate. Mimetics of methionine can be generated by reaction with, e.g., methionine sulfoxide. Mimetics of proline include, e.g., pipecolic acid, thiazolidine carboxylic acid, 3- or 4-hydroxy proline, dehydroproline, 3- or 4-methylproline, or 3,3, dimethylproline. Histidine residue mimetics can be generated by reacting histidyl with, e.g., diethylprocarbonate or para-bromophenacyl bromide. Other mimetics include, e.g., those generated by hydroxylation of proline and lysine; phosphorylation of the hydroxyl groups of seryl or threonyl residues; methylation of the alpha-amino groups of lysine, arginine and histidine; acetylation of the N-terminal amine; methylation of main chain amide residues or substitution with N-methyl amino acids; or amidation of C-terminal carboxyl groups.

In one aspect, a residue, e.g., an amino acid, of a polypeptide of the invention can also be replaced by an amino acid (or peptidomimetic residue) of the opposite chirality. In one aspect, any amino acid naturally occurring in the L-configuration (which can also be referred to as the R or S, depending upon the structure of the chemical entity) can be replaced with the amino acid of the same chemical structural type or a peptidomimetic, but of the opposite chirality, referred to as the D-amino acid, but also can be referred to as the R- or S-form.

The invention also provides methods for modifying the polypeptides of the invention by either natural processes, such as post-translational processing (e.g., phosphorylation, acylation, etc), or by chemical modification techniques, and the resulting modified polypeptides. Modifications can occur anywhere in the polypeptide, including the peptide backbone, the amino acid side-chains and the amino or carboxyl termini. It will be appreciated that the same type of modification may be present in the same or varying degrees at several sites in a given polypeptide. Also a given polypeptide may have many types of modifications. In one aspect, modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of a phosphatidylinositol, cross-linking cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristolyation, oxidation, pegylation, proteolytic processing, phosphorylation, prenylation, racemization, selenoylation, sulfation, and transfer-RNA mediated addition of amino acids to protein such as arginylation. See, e.g., Creighton, T. E., Proteins—Structure and Molecular Properties 2nd Ed., W.H. Freeman and Company, New York (1993); Posttranslational Covalent Modification of Proteins, B. C. Johnson, Ed., Academic Press, New York, pp. 1-12 (1983).

Solid-phase chemical peptide synthesis methods can also be used to synthesize the polypeptide or fragments of the invention. Such method have been known in the art since the early 1960's (Merrifield, R. B., J. Am. Chem. Soc., 85:2149-2154, 1963) (See also Stewart, J. M. and Young, J. D., Solid Phase Peptide Synthesis, 2nd Ed., Pierce Chemical Co., Rockford, Ill., pp. 11-12)) and have recently been employed in commercially available laboratory peptide design and synthesis kits (Cambridge Research Biochemicals). Such commercially available laboratory kits have generally utilized the teachings of H. M. Geysen et al, Proc. Natl. Acad. Sci., USA, 81:3998 (1984) and provide for synthesizing peptides upon the tips of a multitude of "rods" or "pins" all of which are connected to a single plate. When such a system is utilized, a plate of rods or pins is inverted and inserted into a second plate of corresponding wells or reservoirs, which contain solutions for attaching or anchoring an appropriate amino acid to the pin's or rod's tips. By repeating such a process step, i.e., inverting and inserting the rod's and pin's tips into appropriate solutions, amino acids are built into desired peptides. In addition, a number of available FMOC peptide synthesis systems are available. For example, assembly of a polypeptide or fragment can be carried out on a solid support using an Applied Biosystems, Inc. Model 431A™ automated peptide synthesizer. Such equipment provides ready access to the peptides of the invention, either by direct synthesis or by synthesis of a series of fragments that can be coupled using other known techniques.

The polypeptides of the invention include cellulase, e.g., endoglucanase, cellobiohydrolase, beta-glucosidase, xylanase, mannanse, β-xylosidase, arabinofuranosidase, and/or oligomerase enzymes in an active or inactive form. For example, the polypeptides of the invention include proproteins before "maturation" or processing of prepro sequences, e.g., by a proprotein-processing enzyme, such as a proprotein convertase to generate an "active" mature protein. The polypeptides of the invention include cellulase, e.g., endoglucanase, cellobiohydrolase, beta-glucosidase, xylanase, mannanse, β-xylosidase, arabinofuranosidase, and/or oligomerase enzymes inactive for other reasons, e.g., before "activation" by a post-translational processing event, e.g., an endo- or exo-peptidase or proteinase action, a phosphorylation event, an amidation, a glycosylation or a sulfation, a dimerization event, and the like. The polypeptides of the invention include all active forms, including active subsequences, e.g., catalytic domains or active sites, of the enzyme.

The invention includes immobilized cellulase, e.g., endoglucanase, cellobiohydrolase, beta-glucosidase, xylanase, mannanse, β-xylosidase, arabinofuranosidase, and/or oligomerase enzymes, anti-cellulase, e.g., anti-endoglucanase, anti-cellobiohydrolase and/or anti-beta-glucosidase antibodies and fragments thereof. The invention provides methods for inhibiting cellulase, e.g., endoglucanase, cellobiohydrolase, beta-glucosidase, xylanase, mannanse, β-xylosidase, arabinofuranosidase, and/or oligomerase enzyme activity, e.g., using dominant negative mutants or anti-cellulase, e.g., anti-endoglucanase, anti-cellobiohydrolase and/or anti-beta-glucosidase antibodies of the invention. The invention includes heterocomplexes, e.g., fusion proteins, heterodimers, etc., comprising the cellulase, e.g., endoglucanase, cellobiohydrolase, beta-glucosidase, xylanase, mannanse, β-xylosidase, arabinofuranosidase, and/or oligomerase enzymes of the invention.

Polypeptides of the invention can have a cellulase, e.g., endoglucanase, cellobiohydrolase, beta-glucosidase, xylanase, mannanse, β-xylosidase, arabinofuranosidase, and/or oligomerase enzyme activity under various conditions, e.g., extremes in pH and/or temperature, oxidizing agents, and the like. The invention provides methods leading to alternative cellulase, e.g., endoglucanase, cellobiohydrolase, beta-glucosidase, xylanase, mannanse, β-xylosidase, arabinofuranosidase, and/or oligomerase enzyme preparations with different catalytic efficiencies and stabilities, e.g., towards temperature, oxidizing agents and changing wash conditions. In one aspect, cellulase, e.g., endoglucanase, cellobiohydrolase, beta-glucosidase, xylanase, mannanse, β-xylosidase, arabinofuranosidase, and/or oligomerase enzyme variants can be produced using techniques of site-directed mutagenesis and/or random mutagenesis. In one aspect, directed evolution can be used to produce a great variety of cellulase, e.g., endoglucanase, cellobiohydrolase, beta-glucosidase, xylanase, mannanse, β-xylosidase, arabinofuranosidase, and/or oligomerase enzyme variants with alternative specificities and stability.

The proteins of the invention are also useful as research reagents to identify cellulase, e.g., endoglucanase, cellobiohydrolase, beta-glucosidase, xylanase, mannanse, β-xylosidase, arabinofuranosidase, and/or oligomerase enzyme modulators, e.g., activators or inhibitors of cellulase, e.g., endoglucanase, cellobiohydrolase, beta-glucosidase, xylanase, mannanse, β-xylosidase, arabinofuranosidase, and/or oligomerase enzyme activity. Briefly, test samples (compounds, broths, extracts, and the like) are added to cellulase, e.g., endoglucanase, cellobiohydrolase, beta-glucosidase, xylanase, mannanse, β-xylosidase, arabinofuranosidase, and/or oligomerase enzyme assays to determine their ability to inhibit substrate cleavage. Inhibitors identified in this way can be used in industry and research to reduce or prevent undesired proteolysis. As with cellulase, e.g., endoglucanase, cellobiohydrolase, beta-glucosidase, xylanase, mannanse, β-xylosidase, arabinofuranosidase, and/or oligomerase enzymes, inhibitors can be combined to increase the spectrum of activity.

The enzymes of the invention are also useful as research reagents to digest proteins or in protein sequencing. For example, the cellulase, e.g., endoglucanase, cellobiohydrolase, beta-glucosidase, xylanase, mannanse, β-xylosidase, arabinofuranosidase, and/or oligomerase enzymes may be used to break polypeptides into smaller fragments for sequencing using, e.g. an automated sequencer.

The invention also provides methods of discovering new cellulase, e.g., endoglucanase, cellobiohydrolase, beta-glucosidase, xylanase, mannanse, β-xylosidase, arabinofuranosidase, and/or oligomerase enzymes using the nucleic acids, polypeptides and antibodies of the invention. In one aspect, phagemid libraries are screened for expression-based discovery of cellulase, e.g., endoglucanase, cellobiohydrolase, beta-glucosidase, xylanase, mannanse, β-xylosidase, arabinofuranosidase, and/or oligomerase enzymes. In another aspect, lambda phage libraries are screened for expression-based discovery of cellulase, e.g., endoglucanase, cellobiohydrolase, beta-glucosidase, xylanase, mannanse, β-xylosidase, arabinofuranosidase, and/or oligomerase enzymes. Screening of the phage or phagemid libraries can allow the detection of toxic clones; improved access to substrate; reduced need for engineering a host, by-passing the potential for any bias resulting from mass excision of the library; and, faster growth at low clone densities. Screening of phage or phagemid libraries can be in liquid phase or in solid phase. In one aspect, the invention provides screening in liquid phase. This gives a greater flexibility in assay conditions; additional substrate flexibility; higher sensitivity for weak clones; and ease of automation over solid phase screening.

The invention provides screening methods using the proteins and nucleic acids of the invention and robotic automation to enable the execution of many thousands of biocatalytic reactions and screening assays in a short period of time, e.g., per day, as well as ensuring a high level of accuracy and reproducibility (see discussion of arrays, below). As a result, a library of derivative compounds can be produced in a matter of weeks. For further teachings on modification of molecules, including small molecules, see PCT/US94/09174; U.S. Pat. No. 6,245,547.

In one aspect, polypeptides or fragments of the invention are obtained through biochemical enrichment or purification procedures. The sequence of potentially homologous polypeptides or fragments may be determined by cellulase, e.g., endoglucanase, cellobiohydrolase, beta-glucosidase, xylanase, mannanse, β-xylosidase, arabinofuranosidase, and/or oligomerase enzyme assays (see, e.g., Examples 1, 2 and 3, below), gel electrophoresis and/or microsequencing. The sequence of the prospective polypeptide or fragment of the invention can be compared to an exemplary polypeptide of the invention, or a fragment, e.g., comprising at least about 5, 10, 15, 20, 25, 30, 35, 40, 50, 75, 100, or 150 or more consecutive amino acids thereof using any of the programs described above.

Another aspect of the invention is an assay for identifying fragments or variants of the invention, which retain the enzymatic function of the polypeptides of the invention. For example the fragments or variants of said polypeptides, may be used to catalyze biochemical reactions, which indicate that the fragment or variant retains the enzymatic activity of a polypeptide of the invention. An exemplary assay for determining if fragments of variants retain the enzymatic activity of the polypeptides of the invention includes the steps of: contacting the polypeptide fragment or variant with a substrate molecule under conditions which allow the polypeptide fragment or variant to function and detecting either a decrease in the level of substrate or an increase in the level of the specific reaction product of the reaction between the polypeptide and substrate.

The present invention exploits the unique catalytic properties of enzymes. Whereas the use of biocatalysts (i.e., purified or crude enzymes, non-living or living cells) in chemical transformations normally requires the identification of a particular biocatalyst that reacts with a specific starting compound, the present invention uses selected biocatalysts and reaction conditions that are specific for functional groups that are present in many starting compounds, such as small molecules. Each biocatalyst is specific for one functional group, or several related functional groups and can react with many starting compounds containing this functional group.

In one aspect, the biocatalytic reactions produce a population of derivatives from a single starting compound. These derivatives can be subjected to another round of biocatalytic reactions to produce a second population of derivative compounds. Thousands of variations of the original small molecule or compound can be produced with each iteration of biocatalytic derivatization.

Enzymes react at specific sites of a starting compound without affecting the rest of the molecule, a process which is very difficult to achieve using traditional chemical methods. This high degree of biocatalytic specificity provides the means to identify a single active compound within the library. The library is characterized by the series of biocatalytic reactions used to produce it, a so-called "biosynthetic history". Screening the library for biological activities and tracing the biosynthetic history identifies the specific reaction sequence producing the active compound. The reaction sequence is repeated and the structure of the synthesized compound determined. This mode of identification, unlike other synthesis and screening approaches, does not require immobilization technologies and compounds can be synthesized and tested free in solution using virtually any type of screening assay. It is important to note, that the high degree of specificity of enzyme reactions on functional groups allows for the "tracking" of specific enzymatic reactions that make up the biocatalytically produced library.

In one aspect, procedural steps are performed using robotic automation enabling the execution of many thousands of biocatalytic reactions and/or screening assays per day as well as ensuring a high level of accuracy and reproducibility. Robotic automation can also be used to screen for cellulase activity to determine if a polypeptide is within the scope of the invention. As a result, in one aspect, a library of derivative compounds can be produced in a matter of weeks which would take years to produce using "traditional" chemical or enzymatic screening methods.

In a particular aspect, the invention provides a method for modifying small molecules, comprising contacting a polypeptide encoded by a polynucleotide described herein or enzymatically active fragments thereof with a small molecule to produce a modified small molecule. A library of modified small molecules is tested to determine if a modified small molecule is present within the library, which exhibits a desired activity. A specific biocatalytic reaction which produces the modified small molecule of desired activity is identified by systematically eliminating each of the biocatalytic reactions used to produce a portion of the library and then testing the small molecules produced in the portion of the library for the presence or absence of the modified small molecule with the desired activity. The specific biocatalytic reactions which produce the modified small molecule of desired activity is optionally repeated. The biocatalytic reactions are conducted with a group of biocatalysts that react with distinct structural moieties found within the structure of a small molecule, each biocatalyst is specific for one structural moiety or a group of related structural moieties; and each biocatalyst reacts with many different small molecules which contain the distinct structural moiety.

Cellulase, e.g., Endoglucanase, Cellobiohydrolase and/or Beta-Glucosidase Enzyme Signal Sequences, Prepro and Catalytic Domains The invention provides cellulase, e.g., endoglucanase, cellobiohydrolase, beta-glucosidase, xylanase, mannanse, β-xylosidase, arabinofuranosidase, and/or oligomerase enzyme signal sequences (e.g., signal peptides (SPs)), prepro domains and catalytic domains (CDs). The SPs, prepro domains and/or CDs of the invention can be isolated, synthetic or recombinant peptides or can be part of a fusion protein, e.g., as a heterologous domain in a chimeric protein. The invention provides nucleic acids encoding these catalytic domains (CDs), prepro domains and signal sequences (SPs, e.g., a peptide having a sequence comprising/consisting of amino terminal residues of a polypeptide of the invention).

The invention provides isolated, synthetic or recombinant signal sequences (e.g., signal peptides) consisting of or comprising the sequence of (a sequence as set forth in) residues 1 to 14, 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 28, 1 to 30, 1 to 31, 1 to 32, 1 to 33, 1 to 34, 1 to 35, 1 to 36, 1 to 37, 1 to 38, 1 to 40, 1 to 41, 1 to 42, 1 to 43, 1 to 44, 1 to 45, 1 to 46, or 1 to 47, or more, of a polypeptide of the invention, e.g., exemplary polypeptides of the invention, see also Table 3, Examples 1 and 4, below, and Sequence Listing.

In one aspect, the invention provides signal sequences comprising the first 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70 or more amino terminal residues of a polypeptide of the invention.

For example, Table 3, below, sets forth exemplary signal (leader) sequences of the invention, e.g., as in the polypeptide having the sequence of SEQ ID NO:2, encoded, e.g., by SEQ ID NO:1, has a signal sequence comprising (or consisting of) the amino terminal 18 residues of SEQ ID NO:2, or, MYKQLALASLSLFGLVNA. Additional exemplary signal sequences are similarly set forth in Table 3 (these are exemplary signal sequences, and the invention is not limited to these exemplary sequences, for example, another signal sequence for SEQ ID NO:2 may be MYKQLALASLSLF-GLVN, etc.). Table 3 also sets forth other information regarding the exemplary sequences of the invention. For example, in the first row, SEQ ID NO:1, 2, represent the exemplary polypeptide of the invention having a sequence as set forth in SEQ ID NO:2, encoded by, e.g., SEQ ID NO:1; this exemplary sequence has cellobiohydrolases activity; a signal sequence is predicted to be MYKQLALASLSLFGLVNA (amino acids 1 through 18 at the amino terminal end); this exemplary sequence was initially isolated from an environmental sample, therefore it is classified as being from an unknown source; and the "EC" number for this cellobiohydrolase enzyme is 3.2.1.91 (an EC number is the number assigned to a type of enzyme according to a scheme of standardized enzyme nomenclature developed by the Enzyme Commission of the Nomenclature Committee of the International Union of Biochemistry and Molecular Biology, or IUBMB).

TABLE 3

| SEQ ID NOs: | Activity | Signalp Cleavage Site (AA = Amino Acid) | Predicted Signal Sequence | Source | Predicted EC Number |
|---|---|---|---|---|---|
| 1, 2 | Cellobiohydrolase | Probability: 0.999 AA1: 18 AA2: 19 | MYKQLALASLSL FGLVNA | Unknown | 3.2.1.91 |
| 101, 102 | | | | Clostridium thermocellum | 3.2.1.8 |
| 103, 104 | | | | Cochliobolus heterostrophus ATCC 48331 | 3.2.1.55 |
| 105, 106 | | Probability: 1.000 AA1: 25 AA2: 26 | MKKIVSLVCVLV MLVSILGSFSVV A | Clostridium thermocellum | 3.2.1.4 |
| 107, 108 | | | | Unknown | 3.2.1.4 |
| 109, 110 | | Probability: 0.984 AA1: 39 AA2: 40 | MSSFKASAINPR MAGALTRSLYAA GFSLAVSTLSTQ AYA | Unknown | 3.2.1.4 |
| 11, 12 | Cellobiohydrolase | Probability: 1.000 AA1: 18 AA2: 19 | MQRTSAWALLL LAQIATA | Unknown | 3.2.1.91 |
| 111, 112 | | Probability: 0.984 AA1: 39 AA2: 40 | MSSFKASAINPR MAGALTRSLYAA GFSLAVSTLSTQ AYA | Unknown | 3.2.1.4 |
| 113, 114 | | Probability: 0.985 AA1: 39 AA2: 40 | MSSFKASAINPR MAGTLTRSLYAA GFSLAVSTLSTQ AYA | Unknown | 3.2.1.4 |
| 115, 116 | | Probability: 1.000 AA1: 29 AA2: 30 | MRKIILKFCALM MVVILIVSILQI LPVFA | Unknown | 3.2.1.4 |
| 117, 118 | | Probability: 1.000 AA1: 34 AA2: 35 | MKKRQGFIKKGL VLGVSLLLLALI MMSATSQTSA | Unknown | 3.2.1.8 |
| 119, 120 | | Probability: 1.000 AA1: 33 AA2: 34 | MSRNIRKSSFIF SLLTIIVLIASM FLQTQTAQA | Unknown | 3.2.1.91 |
| 121, 122 | | Probability: 1.000 AA1: 28 AA2: 29 | MLIRLAAAGALL LGAVFVAVSPAA AATA | Unknown | 3.2.1.8 |
| 123, 124 | | Probability: 1.000 AA1: 29 AA2: 30 | MRLKTLATATAA AAVVAGTAVLW PGSASA | Unknown | 3.2.1.91 |
| 125, 126 | | Probability: 0.999 AA1: 32 AA2: 33 | MFKRNTVRVGCF IAVTAICAMLLF HVPSVVSA | Unknown | 3.2.1.4 |
| 127, 128 | | Probability: 1.000 AA 1:42 AA2: 43 | MSGEPHVSLRLS RPRRRTAILAAV AACTVTAGAWLA TGTASA | Unknown | 3.2.1.8 |
| 129, 130 | | Probability: 1.000 AA1: 23 AA2: 24 | MKRSLCLVLVLL VILSACVQNYA | Unknown | 3.2.1.4 |

TABLE 3-continued

| SEQ ID NOs: | Activity | Signalp Cleavage Site (AA = Amino Acid) | Predicted Signal Sequence | Source | Predicted EC Number |
|---|---|---|---|---|---|
| 13, 14 | B-glucosidase | | | Unknown | 3.2.1.21 |
| 131, 132 | | Probability: 0.994 AA1: 22 AA2: 23 | MMKGFRWCVMAM VVMAATNVRA | Unknown | 3.2.1.4 |
| 133, 134 | | Probability: 1.000 AA1: 35 AA2: 36 | MPTGLRAKPCLT RWLAASACALAP LLLGAPASALA | Unknown | 3.2.1.4 |
| 135, 136 | | Probability: 0.999 AA1: 24 AA2: 25 | MSMITPKTKSYG LAAMLSLGLAVA | Unknown | 3.2.1.4 |
| 137, 138 | | Probability: 0.999 AA1: 33 AA2: 34 | MKFPLQFLPLIF IRVLRLCLIPLL VFTSNFSVA | Unknown | 3.2.1.4 |
| 139, 140 | | Probability: 0.961 AA1: 34 AA2: 35 | MPLCTTKHLLPA LVLVTASSFMLG CGNSTTPAEK | Unknown | 3.2.1.4 |
| 141, 142 | | Probability: 1.000 AA1: 41 AA2: 42 | MNNKLPGRSANG KRHSSPRKSILN SVIGILAGSLLS GLALA | Unknown | 3.2.1.4 |
| 143, 144 | | | | Clostridium thermocellum | |
| 145, 146 | | | | Clostridium thermocellum | 3.2.1.4 |
| 147, 148 | β-glucosidase | | | Unknown | |
| 149, 150 | β-glucosidase | | | Unknown | 3.2.1.23 |
| 15, 16 | B-glucosidase | Probability: 1.000 AA1: 22 AA2: 23 | MKIRSLLLLISI LLGVVSPGFG | Unknown | 3.2.1.21 |
| 151, 152 | | Probability: 0.973 AA1: 21 AA2: 22 | MRNFFKVFTLVL VVISVMLFG | Unknown | 3.2.1.4 |
| 153, 154 | | Probability: 0.997 AA1: 25 AA2: 26 | MKRRNWNYLLII LLVISAFTLISA Q | Unknown | 3.2.1.4 |
| 155, 156 | | Probability: 1.000 AA1: 24 AA2: 25 | MKRVAIILSVLT LLATIMSFPASA | Unknown | 3.2.1.4 |
| 157, 158 | | Probability: 1.000 AA1: 21 AA2: 22 | MNVLRSGIVTML LLAAFSVQA | Unknown | 3.2.1.4 |
| 159, 160 | | Probability: 1.000 AA1: 29 AA2: 30 | MKRSISIFITCL LITLLTMGGMIA SPASA | Unknown | 3.2.1.4 |
| 161, 162 | | Probability: 1.000 AA1: 22 AA2: 23 | MRGQKLWVALAA LLSVGSVALA | Unknown | 3.2.1.4 |
| 163, 164 | β-glucosidase | Probability: 1.000 AA1: 27 AA2: 28 | MSKIKHPKLLLC LLPVFGMFNCQN VLS | Unknown | 3.2.1.21 |
| 165, 166 | | Probability: 0.937 AA1: 17 AA2: 18 | MSKAKLYVILLF FSVVA | Unknown | 3.2.1.4 |
| 167, 168 | | Probability: 1.000 AA1: 24 AA2: 25 | MFIGFRLSIASL LACLLFPMQALA | Unknown | 3.2.1.4 |
| 169, 170 | | Probability: 1.000 AA1: 26 AA2: 27 | MRCPSLLSIKNL LALIGILLTAPV FA | Unknown | 3.2.1.4 |
| 17, 18 | B-glucosidase | | | Unknown | 3.2.1.21 |
| 171, 172 | β-glucosidase | | | Unknown | 3.2.1.21 |

TABLE 3-continued

| SEQ ID NOs: | Activity | Signalp Cleavage Site (AA = Amino Acid) | Predicted Signal Sequence | Source | Predicted EC Number |
|---|---|---|---|---|---|
| 173, 174 | | Probability: 0.993 AA1: 19 AA2: 20 | MKSVLALALIVS INLVLLA | Unknown | 3.2.1.4 |
| 175, 176 | | Probability: 0.924 AA1: 36 AA2: 37 | MTFEKPIFERFR LPSCKPVILGLL SLALAACGGVPG | Unknown | 3.2.1.4 |
| 177, 178 | | Probability: 1.000 AA1: 46 AA2: 47 | MLVYRVSIQICH LASLTVLVSLLL ILAGCSSSSDSI APVSSSSVSSA | Unknown | 3.2.1.4 |
| 179, 180 | β-glucosidase | Probability: 1.000 AA1: 22 AA2: 23 | MKKRIISAGLTF LIGVSLQAQS | Unknown | 3.2.1.21 |
| 181, 182 | | Probability: 1.000 AA1: 29 AA2: 30 | MKRTILRFSKFL KIVILITFTLQI FTVFA | Unknown | 3.2.1.4 |
| 183, 184 | | Probability: 0.999 AA1: 29 AA2: 30 | MREIILKSGALL MVVILIVSILQI LTVFA | Unknown | 3.2.1.4 |
| 185, 186 | | Probability: 0.999 AA1: 29 AA2: 30 | MREIILKSGALL MVVILIVSILQI LTVFA | Unknown | 3.2.1.4 |
| 187, 188 | β-glucosidase | | | Thermosphaera aggregans M11TL | 3.2.1.23 |
| 189, 190 | | Probability: 0.997 AA1: 22 AA2: 23 | MKGFRWCVLAVL MLAATNLRAA | Unknown | 3.2.1.4 |
| 19, 20 | Cellobio-hydrolase | Probability: 0.972 AA1: 19 AA2: 28 | MLRYLSIVAATA ILTGVEA | Unknown | 3.2.1.91 |
| 191, 192 | | Probability: 1.000 AA1: 24 AA2: 25 | MKKITRCCTLIC AAIMLLNCSSSA | Unknown | 3.2.1.4 |
| 193, 194 | | Probability: 1.000 AA1: 23 AA2: 24 | MRKPACATLAVM MSLLFTPFSQA | Unknown | 3.2.1.4 |
| 195, 196 | | Probability: 1.000 AA1: 29 AA2: 30 | MKRSISVFIACF MVAALGISGIIA PKAAA | Unknown | 3.2.1.4 |
| 197, 198 | | | | Unknown | 3.2.1.4 |
| 199, 200 | | Probability: 0.979 AA1: 16 AA2: 17 | MKFFTVLLFFLS FVFS | Aquifex aeolicus | 3.2.1.4 |
| 201, 202 | | Probability: 0.981 AA1: 29 AA2: 30 | MFPRLSPSRFRQ VTLTLLTLGLVS LTGCA | Unknown | |
| 203, 204 | | Probability: 1.000 AA1: 22 AA2: 23 | MWQRSKTLVLVL GLLLSHQAFA | Unknown | 3.2.1.4 |
| 205, 206 | | Probability: 1.000 AA1: 30 AA2: 31 | MGTSLMIKSTLT GMITAVAAAVFT TSAAFA | Bacteria | 3.2.1.91 |
| 207, 208 | | | | Unknown | 3.2.1.4 |
| 209, 210 | | Probability: 1.000 AA1: 19 AA2: 20 | MLVRLLIAMTVL FSAFAHA | Unknown | 3.2.1.4 |
| 21, 22 | Cellobio-hydrolase | Probability: 0.997 AA1: 17 AA2: 18 | MLTLAFLSLLAA ANAQK | Unknown | |
| 211, 212 | β-glucosidase | Probability: 1.000 AA1: 23 AA2: 24 | MLTRRELIAATA LGLAASTKLVA | Unknown | 3.2.1.21 |

TABLE 3-continued

| SEQ ID NOs: | Activity | Signalp Cleavage Site (AA = Amino Acid) | Predicted Signal Sequence | Source | Predicted EC Number |
|---|---|---|---|---|---|
| 213, 214 | | | | Unknown | 3.2.1.4 |
| 215, 216 | | | | Unknown | 3.2.1.4 |
| 217, 218 | | Probability: 0.995 AA1: 27 AA2: 28 | MRFRKNFAVLML IVLISTLFLSTQ CKG | Unknown | 3.2.1.4 |
| 219, 220 | | Probability: 0.950 AA1: 30 AA2: 31 | MDELESSCAFPM SRYLLLWVWVML SSSAFA | Unknown | 3.2.1.4 |
| 221, 222 | | Probability: 0.990 AA1: 17 AA2: 18 | MSSVASLLSLTL LQAQA | Unknown | |
| 223, 224 | | Probability: 1.000 AA1: 24 AA2: 25 | MMRTLVTSAFAC LLLPLGTGQADA | Unknown | |
| 225, 226 | β-glucosidase | Probability: 0.999 AA1: 29 AA2: 30 | MNCTMKPMTRAV AGGLAALALA ACGSSDS | Unknown | 3.2.1.21 |
| 227, 228 | β-glucosidase | Probability: 1.000 AA1: 25 AA2: 26 | MTDRDVSRRALL SLAAVAAATPAV A | Unknown | 3.2.1.21 |
| 229, 230 | β-glucosidase | Probability: 1.000 AA1: 23 AA2: 24 | MNRRELLASTLA FSAASALPAAA | Unknown | 3.2.1.21 |
| 23, 24 | B-glucosidase | | | Unknown | 3.2.1.21 |
| 231, 232 | | | | Unknown | |
| 233, 234 | | | | Unknown | 3.2.1.78 |
| 235, 236 | | Probability: 0.994 AA1: 21 AA2: 22 | MRPVILAAITMA LSLFVSCSS | Unknown | 3.2.1.4 |
| 237, 238 | | | | Unknown | 3.2.1.78 |
| 239, 240 | | | | Unknown | 3.2.1.4 |
| 241, 242 | | Probability: 1.000 AA1: 21 AA2: 22 | MNVLRSGLVTML LLAAFSVQA | Unknown | 3.2.1.4 |
| 243, 244 | | Probability: 1.000 AA1: 24 AA2: 25 | MKSKVKMFFAAA IVWSACSSTGYA | Unknown | 3.2.1.89 |
| 245, 246 | | Probability: 1.000 AA1: 32 AA2: 33 | MGKISKYFAMFL AFLMVFSSLFVN FQPRNVQA | Unknown | 3.2.1.89 |
| 247, 248 | | | | Unknown | 3.2.1.89 |
| 249, 250 | β-glucosidase | | | *Thermococcus* AEPIIIa | 3.2.1.23 |
| 25, 26 | Cellobio-hydrolase | Probability: 1.000 AA1: 18 AA2: 19 | MFSKTALLSSIF AAAATA | Unknown | |
| 251, 252 | β-glucosidase | | | *Thermococcus* AEPIIIa | 3.2.1.23 |
| 253, 254 | β-glucosidase | | | *Thermotoga maritima* MSB8 | 3.2.1.21 |
| 255, 256 | | Probability: 1.000 AA1: 30 AA2: 31 | MKVFRNSIIRKS VVLFCAVLWILP AGLSLA | Unknown | |
| 257, 258 | | Probability: 1.000 AA1: 29 AA2: 30 | MKRSVSIFIACL VMTVLTISGVAA PEASA | Unknown | 3.2.1.4 |

TABLE 3-continued

| SEQ ID NOs: | Activity | Signalp Cleavage Site (AA = Amino Acid) | Predicted Signal Sequence | Source | Predicted EC Number |
|---|---|---|---|---|---|
| 259, 260 | | | | Unknown | 3.2.1.4 |
| 261, 262 | | Probability: 0.892 AA1: 19 AA2: 20 | MSKKKFVIVSIL TILLVQA | *Pyrococcus furiosus* VC1 | 3.2.1.4 |
| 263, 264 | β-glucosidase | | | *Pyrococcus furiosus* VC1 | 3.2.1.23 |
| 265, 266 | β-glucosidase | | | Bacteria | 3.2.1.21 |
| 267, 268 | | Probability: 1.000 AA1: 30 AA2: 31 | MNPRSLRRRTTA ALAALAACAALL ATQAQA | Bacteria | 3.2.1.91 |
| 269, 270 | | Probability: 1.000 AA1: 27 AA2: 28 | MRRRIRALVAAL SALPLALVVAPS AHA | Bacteria | |
| 27, 28 | Cellobio-hydrolase | Probability: 0.997 AA1:22 AA2: 23 | MRRRIRALVAAL AGAIGAPAST | Unknown | 3.2.1.91 |
| 271, 272 | β-glucosidase | | | Bacteria | 3.2.1.21 |
| 273, 274 | | Probability: 0.879 AA1: 34 AA2: 35 | MDAGDMNMKFEN RIGRFTRWCSLV AIVGVAPAFA | Unknown | 3.2.1.4 |
| 275, 276 | | Probability: 0.987 AA1: 34 AA2: 35 | MFGNNKTVRLTV VSGLTMLAAGCA TAPCEQPVAA | Unknown | |
| 277, 278 | | Probability: 1.000 AA1: 26 AA2: 27 | MKTKSIYSIAIL SIALFFFTTAQT FS | Unknown | 3.2.1.4 |
| 279, 280 | | Probability: 1.000 AA1: 18 AA2: 19 | MKKLILTLFSLW AISAYA | Unknown | 3.2.1.4 |
| 281, 282 | | | | Unknown | 3.2.1.91 |
| 283, 284 | | Probability: 0.988 AA1: 31 AA2: 32 | MRKIVKQINYLT PSVLGLLVLSLF FQVPTQA | Unknown | 3.2.1.4 |
| 285, 286 | | Probability: 1.000 AA1: 28 AA2: 29 | MKKVSNARVLSF LLILYLIFGNLA SVFA | Unknown | 3.2.1.4 |
| 287, 288 | | Probability: 1.000 AA1: 24 AA2: 25 | MTRNWLGKILAA LLLAGCAIPAPA | Unknown | 3.2.1.4 |
| 289, 290 | | | | Unknown | 3.2.1.4 |
| 29, 30 | B-glucosidase | | | Unknown | 3.2.1.21 |
| 291, 292 | | Probability: 0.998 AA1: 29 AA2: 30 | MRRFRVVFLGLF VFFGIVIASQYG QTAAA | Unknown | |
| 293, 294 | | Probability: 1.000 AA1: 29 AA2: 30 | MKKIILKSGILL LVVILIVSILQI LPVFA | Unknown | 3.2.1.4 |
| 295, 296 | | Probability: 0.983 AA1: 33 AA2: 34 | MKRTRYGVRSPR SAPRFGVLFGAA AAGVLMTGA | Unknown | |
| 297, 298 | β-glucosidase | Probability: 1.000 AA1: 18 AA2: 19 | MRKLLTALLVTV AIGANA | Unknown | 3.2.1.21 |
| 299, 300 | | Probability: 1.000 AA1: 22 AA2: 23 | MTSKHFFKITLM SILLFTTTLA | Unknown | 3.2.1.4 |

TABLE 3-continued

| SEQ ID NOs: | Activity | Signalp Cleavage Site (AA = Amino Acid) | Predicted Signal Sequence | Source | Predicted EC Number |
|---|---|---|---|---|---|
| 3, 4 | B-glucosidase | Probability: 1.000 AA1: 33 AA2: 34 | MLSNRRLIRTIP LGAAAYSVLLGL AGCSQSTVA | Unknown | 3.2.1.21 |
| 301, 302 | | Probability: 1.000 AA1: 32 AA2: 33 | MFQSLKMRTLSF LLLMALLASFLA LPTDVAHA | Unknown | 3.2.1.4 |
| 303, 304 | β-glucosidase | Probability: 0.989 AA1: 27 AA2: 28 | MALSTVSKVMLL TCAAVLLTIPGC NSA | Unknown | 3.2.1.21 |
| 305, 306 | | Probability: 0.825 AA1: 17 AA2: 18 | MAIGISATMLLA MPQQA | Unknown | 3.2.1.4 |
| 307, 308 | | Probability: 0.847 AA1: 30 AA2: 31 | MSCRTLMSRRVG WGLLLWGGLFLR TGSVTG | Unknown | 3.2.1.4 |
| 309, 310 | β-glucosidase | | | Unknown | 3.2.1.52 |
| 31, 32 | B-glucosidase | | | Unknown | 3.2.1.21 |
| 311, 312 | β-glucosidase | | | Unknown | 3.2.1.21 |
| 313, 314 | | Probability: 1.000 AA1: 25 AA2: 26 | MKTKAVVLSLLL LLSMFGPMGAER A | Unknown | 3.2.1.4 |
| 315, 316 | | | | Clostridium thermocellum | 3.2.1.4 |
| 317, 318 | | | | Unknown | 3.2.1.4 |
| 319, 320 | β-glucosidase | | | Clostridium thermocellum | 3.2.1.21 |
| 321, 322 | β-glucosidase | | | Unknown | 3.2.1.21 |
| 323, 324 | β-glucosidase | | | Unknown | 3.2.1.21 |
| 325, 326 | β-glucosidase | | | Unknown | 3.2.1.21 |
| 327, 328 | β-glucosidase | | | Unknown | 3.2.1.21 |
| 329, 330 | β-glucosidase | | | Unknown | 3.2.1.21 |
| 33, 34 | Cellobio-hydrolase | Probability: 1.000 AA1: 20 AA2: 21 | MYRILATASALL ATARAQQA | Unknown | |
| 331, 332 | β-glucosidase | Probability: 1.000 AA1: 23 AA2: 24 | MNKILKLFSSLL LFAGICPALQA | Unknown | 3.2.1.4 |
| 333, 334 | β-glucosidase | | | Unknown | 3.2.1.21 |
| 335, 336 | β-glucosidase | | | Unknown | 3.2.1.21 |
| 337, 338 | | Probability: 1.000 AA1: 20 AA2: 21 | MSRGILILVMLS VLSGAALA | Unknown | 3.2.1.4 |
| 339, 340 | β-glucosidase | | | Unknown | 3.2.1.21 |
| 341, 342 | β-glucosidase | | | Unknown | 3.2.1.21 |
| 343, 344 | β-glucosidase | | | Unknown | 3.2.1.4 |
| 345, 346 | β-glucosidase | | | Unknown | 3.2.1.21 |
| 347, 348 | β-glucosidase | | | Unknown | 3.2.1.21 |
| 349, 350 | β-glucosidase | | | Unknown | 3.2.1.21 |
| 35, 36 | Cellobio-hydrolase | Probability: 0.994 AA1: 20 AA2: 21 | MYQKLAAISAFL AAARAQQV | Unknown | |

TABLE 3-continued

| SEQ ID NOs: | Activity | Signalp Cleavage Site (AA = Amino Acid) | Predicted Signal Sequence | Source | Predicted EC Number |
|---|---|---|---|---|---|
| 351, 352 | β-glucosidase | | | Unknown | 3.2.1.21 |
| 353, 354 | | Probability: 1.000 AA1: 29 AA2: 30 | MTRRSIVRSSSN KWLVLAGAALLA CTALG | Unknown | 3.2.1.91 |
| 355, 356 | β-glucosidase | | | Unknown | 3.2.1.21 |
| 357, 358 | β-glucosidase | | | Unknown | 3.2.1.21 |
| 359, 360 | | Probability: 0.999 AA1: 29 AA2: 30 | MRNHLNVPFYFI FFFLIASIFTVC SSSTA | Unknown | 3.2.1.4 |
| 361, 362 | β-glucosidase | | | Unknown | 3.2.1.21 |
| 363, 364 | β-glucosidase | | | Unknown | 3.2.1.21 |
| 365, 366 | β-glucosidase | | | Unknown | 3.2.1.21 |
| 367, 368 | β-glucosidase | | | Unknown | 3.2.1.21 |
| 369, 370 | β-glucosidase | | | Unknown | |
| 37, 38 | Endoglucanase | Probability: 1.000 AA1: 20 AA2: 21 | MPKKLLASFIAL FFAANAAA | Unknown | 3.2.1.4 |
| 371, 372 | | Probability: 1.000 AA1: 29 AA2: 30 | MSSKQKTVAIFV LFVALAGVAGSI PASYA | *Thermococcus* AEPIIIa | 3.2.1.4 |
| 373, 374 | β-glucosidase | Probability: 0.986 AA1: 29 AA2: 30 | MNCTLKPMARVV AGCVATLALAAC GSDTG | Unknown | 3.2.1.21 |
| 375, 376 | β-glucosidase | Probability: 1.000 AA1: 27 AA2: 28 | MSLFRPHPLKTA LATVLLGALTGQ ALA | Unknown | 3.2.1.21 |
| 377, 378 | β-glucosidase | Probability: 0.567 AA1: 29 AA2: 30 | MTVEEKVNMVVG GGMFVPGMQMPG AAAQA | Unknown | 3.2.1.21 |
| 379, 380 | β-glucosidase | Probability: 1.000 AA1: 19 AA2: 20 | MKKAFMILGAAL VTLGASA | Unknown | 3.2.1.21 |
| 381, 382 | β-glucosidase | | | Unknown | 3.2.1.21 |
| 383, 384 | β-glucosidase | | | Unknown | 3.2.1.21 |
| 385, 386 | β-glucosidase | | | Unknown | 3.2.1.21 |
| 387, 388 | β-glucosidase | | | *Bacillus* sp. G5308 | 3.2.1.21 |
| 389, 390 | β-glucosidase | | | Unknown | 3.2.1.21 |
| 39, 40 | Endoglucanase | | | Unknown | |
| 391, 392 | β-glucosidase | | | Unknown | 3.2.1.21 |
| 393, 394 | β-glucosidase | | | Unknown | 3.2.1.21 |
| 395, 396 | β-glucosidase | Probability: 1.000 AA1: 28 AA2: 29 | MSHSKKLILTGS LSAVALCAMMLT PATA | *Thermotoga maritima* MSB8 | 3.2.1.21 |
| 397, 398 | β-glucosidase | | | Unknown | 3.2.1.21 |
| 399, 400 | β-glucosidase | | | Unknown | 3.2.1.21 |
| 401, 402 | β-glucosidase | Probability: 0.962 AA1: 19 AA2: 20 | MNATLRISLILL IMVSGYA | Unknown | 3.2.1.21 |

TABLE 3-continued

| SEQ ID NOs: | Activity | Signalp Cleavage Site (AA = Amino Acid) | Predicted Signal Sequence | Source | Predicted EC Number |
|---|---|---|---|---|---|
| 403, 404 | β-glucosidase | | | Unknown | 3.2.1.21 |
| 405, 406 | β-glucosidase | | | Unknown | 3.2.1.21 |
| 407, 408 | β-glucosidase | | | Unknown | 3.2.1.21 |
| 409, 410 | β-glucosidase | | | Unknown | 3.2.1.21 |
| 41, 42 | B-glucosidase | | | Unknown | 3.2.1.21 |
| 411, 412 | β-glucosidase | Probability: 0.998 AA1:26 AA2: 27 | MSCFAKRFTPKL LTVLTTFIAMAC FA | Unknown | 3.2.1.21 |
| 413, 414 | β-glucosidase | Probability: 1.000 AA1: 28 AA2: 29 | MKYLRPLSVFLC LVVVLALLLSTP PSSA | Unknown | 3.2.1.21 |
| 415, 416 | | Probability: 0.996 AA1: 20 AA2: 21 | MLIIGGLLVLLG GSSCGRQA | Unknown | 3.2.1.4 |
| 417, 418 | β-glucosidase | | | Unknown | 3.2.1.21 |
| 419, 420 | β-glucosidase | | | Unknown | 3.2.1.21 |
| 421, 422 | β-glucosidase | | | Unknown | 3.2.1.21 |
| 423, 424 | β-glucosidase | Probability: 1.000 AA1: 29 AA2: 30 | MNHAARRRTLLG LGTALAGATLLP RGAAA | Unknown | 3.2.1.21 |
| 425, 426 | β-glucosidase | | | Unknown | 3.2.1.52 |
| 427, 428 | | | | *Thermotoga maritima* MSB8 | 3.2.1.4 |
| 429, 430 | | | | *Thermotoga maritima* MSB8 | 3.2.1.4 |
| 43, 44 | Cellobio-hydrolase | | | Unknown | 3.2.1.91 |
| 431, 432 | β-glucosidase | | | Unknown | 3.2.1.21 |
| 433, 434 | PFAM: galactopyranose mutase | | | Unknown | 5.4.99.9 |
| 435, 436 | β-glucosidase | | | Unknown | 3.2.1.21 |
| 437, 438 | β-glucosidase | Probability: 0.979 AA1: 25 AA2: 26 | MTTFNVSAVATA PAPTASTTRPAA A | Unknown | 3.2.1.21 |
| 439, 440 | | Probability: 1.000 AA1: 25 AA2: 26 | MTHKTKSIASLS LILMLLAVPLAL A | Unknown | 3.5.2.6 |
| 441, 442 | | | | *Thermotoga maritima* MSB8 | 3.2.1.139 |
| 443, 444 | | Probability: 1.000 AA1: 25 AA2: 26 | MNFSLRKAAAAL ACVAGLYASSAG A | Unknown | 3.2.1.8 |
| 445, 446 | | Probability: 0.981 AA1: 25 AA2: 26 | MSAALSYRIYKN ALLFTAFLTAAR A | *Agaricus bisporus* ATCC 62489 | |
| 447, 448 | | Probability: 1.000 AA1: 20 AA2: 21 | MIVGFSFMLLLP LGMTNALA | Unknown | 3.2.1.8 |
| 449, 450 | | Probability: 1.000 AA1: 19 AA2: 20 | MRFPSIFTAVLF AASSALA | *Cochliobolus heterostrophus* ATCC 48331 | 3.2.1.91 |

TABLE 3-continued

| SEQ ID NOs: | Activity | Signalp Cleavage Site (AA = Amino Acid) | Predicted Signal Sequence | Source | Predicted EC Number |
|---|---|---|---|---|---|
| 45, 46 | Cellobio-hydrolase | Probability: 0.965 AA1: 16 AA2: 17 | MSLLLTALSLVA AAKA | Unknown | |
| 451, 452 | | Probability: 0.952 AA1: 17 AA2: 18 | MYRVIATASALI ATARA | Unknown | |
| 453, 454 | | | | Unknown | 3.2.1.21 |
| 455, 456 | | | | Unknown | 3.2.1.55 |
| 457, 458 | | | | Unknown | 3.2.1. |
| 459, 460 | | | | Bacillus licheniformis | 3.2.1.55 |
| 461, 462 | | | | Unknown | 3.2.1.55 |
| 463, 464 | | | | Unknown | 3.2.1.55 |
| 465, 466 | | | | Bacillus halodurans ATCC | 3.2.1.55 |
| 467, 468 | | | | Thermotoga maritima MSB8 | 3.2.1.55 |
| 469, 470 | | | | Unknown | 3.2.1.55 |
| 47, 48 | Endoglucanase | Probability: 1.000 AA1: 28 AA2: 29 | MRKNILMLAVAM IAAMCLTTSCGN KAQK | Unknown | 3.2.1.4 |
| 471, 472 | | | | Unknown | 3.2.1.55 |
| 473, 474 | | | | Unknown | 3.2.1.55 |
| 475, 476 | | | | Unknown | 3.2.1.55 |
| 477, 478 | | | | Unknown | 3.2.1.55 |
| 479, 480 | | Probability: 1.000 AA1: 19 AA2: 20 | MKTFILAAAALG VAMPGVA | Unknown | 3.2.1.37 |
| 481, 482 | | | | Unknown | 3.2.1.55 |
| 483, 484 | | | | Unknown | 3.2.1.55 |
| 485, 486 | | | | Unknown | 3.2.1.55 |
| 487, 488 | | | | Unknown | 3.2.1.55 |
| 489, 490 | | | | Unknown | 3.2.1.55 |
| 49, 50 | B-glucosidase | Probability: 0.999 AA1: 24 AA2: 25 | MKTTKAVTLLAM GGALFALTACNG | Unknown | 3.2.1.21 |
| 491, 492 | | | | Unknown | 3.2.1.21 |
| 493, 494 | | | | Unknown | 3.2.1.21 |
| 495, 496 | | | | Unknown | |
| 497, 498 | | | | Unknown | 3.2.1.37 |
| 499, 500 | | Probability: 0.998 AA1: 25 AA2: 26 | MKKRAFSFSLCV AHSTFWLPVAHM | Unknown | 3.2.1.21 |
| 5, 6 | B-glucosidase | | | Unknown | 3.2.1.21 |
| 501, 502 | | | | Unknown | |
| 503, 504 | | | | Unknown | |
| 505, 506 | | | | Unknown | |

TABLE 3-continued

| SEQ ID NOs: | Activity | Signalp Cleavage Site (AA = Amino Acid) | Predicted Signal Sequence | Source | Predicted EC Number |
|---|---|---|---|---|---|
| 507, 508 | | Probability: 0.993 AA1: 27 AA2: 28 | NIQNRREFLQLL FAGAGAGLVLPQ ISFG | Unknown | 3.2.1. |
| 509, 510 | | Probability: 0.926 AA1: 31 AA2: 32 | MTTRREFIRDLL VGGVVVAVAPRF LAFSSVA | Unknown | 3.2.1. |
| 51, 52 | Cellobio-hydrolase | Probability: 1.000 AA1: 27 AA2: 28 | MKGSISYQIYKG ALLLSSLLASVS AQG | Unknown | |
| 511, 512 | | Probability: 0.976 AA1: 27 AA2: 28 | MINRRDFIKDLI ITSAGVAVLPQL AFG | Unknown | 3.2.1. |
| 513, 514 | | Probability: 1.000 AA1: 28 AA2: 29 | MSSRREFIRDLL TGGALIAVAPRL SAFA | Unknown | 3.2.1. |
| 515, 516 | | | | *Cochliobolus heterostrophus* ATCC 48331 | 3.2.1.21 |
| 517, 518 | | Probability: 1.000 AA1: 34 AA2: 35 | MTTTRRTILKAA ASAGAIASTGWP ALAAAQAAQA | Unknown | 3.2.1. |
| 53, 54 | Cellobio-hydrolase | Probability: 0.995 AA1: 23 AA2: 24 | MSALNSFNMYKS ALILGSLLATA | Unknown | |
| 55, 56 | Cellobio-hydrolase | Probability: 0.999 AA1: 20 AA2: 21 | MYRTLAIASSIL AVAQGQLA | Unknown | |
| 57, 58 | B-glucosidase | Probability: 0.996 AA1: 30 AA2: 31 | MTTRVGRCAQAK LLLGFCALALAS CQTATT | Unknown | 3.2.1.21 |
| 59, 60 | Cellobiohydrolase | | | Unknown | 3.2.1.91 |
| 61, 62 | Endoglucanase | | | Unknown | 3.2.1.4 |
| 63, 64 | Cellobio-hydrolase | Probability: 0.999 AA1: 18 AA2: 19 | MKGLYTALVASA ISGALA | Unknown | 3.2.1.91 |
| 65, 66 | Cellobio-hydrolase | Probability: 1.000 AA1: 18 AA2: 19 | MAVKNILLAAAA LSASVA | Unknown | 3.2.1.91 |
| 67, 68 | Cellobio-hydrolase | Probability: 0.999 AA1: 15 AA2: 16 | MKSATLFALAAT AQA | Unknown | 3.2.1.91 |
| 69, 70 | B-glucosidase | | | Unknown | 3.2.1.21 |
| 7, 8 | B-glucosidase | Probability: 0.999 AA1: 28 AA2: 29 | MNREVPTVSPRP LLVGMIAVLLAA PAAA | Unknown | 3.2.1.21 |
| 71, 72 | Cellobio-hydrolase | Probability: 1.000 AA1: 15 AA2: 16 | MKTATLLALAAT AQA | Unknown | 3.2.1.91 |
| 73, 74 | Cellobio-hydrolase | Probability: 0.999 AA1: 18 AA2: 19 | MLSRTLFLASLL STSLVA | Unknown | |
| 75, 76 | B-glucosidase | | | Unknown | 3.2.1.21 |
| 77, 78 | Cellobio-hydrolase | Probability: 0.998 AA1: 19 AA2: 20 | MYQRALLFSALM AGVSAQQ | Unknown | |
| 79, 80 | B-glucosidase | | | Unknown | 3.2.1.23 |
| 81, 82 | Cellobio-hydrolase | Probability: 1.000 AA1: 18 AA2: 19 | MQRTSAWALLLL AQIATA | Unknown | 3.2.1.91 |
| 83, 84 | Cellobio-hydrolase | Probability: 1.000 AA1: 17 AA2: 18 | MYRRAVLFSALA AAAHA | | |

TABLE 3-continued

| SEQ ID NOs: | Activity | Signalp Cleavage Site (AA = Amino Acid) | Predicted Signal Sequence | Source | Predicted EC Number |
|---|---|---|---|---|---|
| 85, 86 | Endoglucanase | Probability: 1.000 AA1: 28 AA2: 29 | MRKNILMLAVAM IAAMCVTTSCGN KAQK | Unknown | 3.2.1.4 |
| 87, 88 | Cellobio-hydrolase | Probability: 0.963 AA1: 15 AA2: 16 | MLPLVLLSLLGA VTA | Unknown | |
| 89, 90 | B-glucosidase | | | Unknown | 3.2.1.21 |
| 9, 10 | Cellobio-hydrolase | Probability: 0.995 AA1: 23 AA2: 24 | MSALNSFNMYKS ALILGSLLATA | Unknown | |
| 91, 92 | | Probability: 0.999 AA1: 28 AA2: 29 | MTSGRNTCVCLL LIVLAIGLLSKP PASA | Unknown | 3.2.1.55 |
| 93, 94 | B-glucosidase | | | Bacteria | 3.2.1.21 |
| 95, 96 | | | | Unknown | |
| 97, 98 | | Probability: 0.994 AA1: 18 AA2: 19 | MRYTWSVAAALL PCAIQA | Unknown | 3.2.1.91 |
| 99, 100 | | Probability: 1.000 AA1: 23 AA2: 24 | MISLKRVAALLC VAGLGMSAANA | Unknown | 3.2.1.8 |
| 519, 520 | Oligomerase | | | Cochliobolus heterostrophus ATCC 48331 | 3.2.1.21 |
| 521, 522 | Oligomerase | | | Cochliobolus heterostrophus ATCC 48331 | 3.2.1.21 |
| 523, 524 | xylanase | Probability: 1.000 AA1: 29 AA2: 30 | MFMLSKK1LMVL LTISMSFISLFT VTAVA | Unknown | 3.2.1.8 |

The invention includes polypeptides with or without a signal sequence (e.g., as described above and/or set forth in Table 3) and/or a prepro sequence. The invention includes polypeptides with heterologous signal sequences and/or prepro sequences (for example, polypeptides of the invention include enzymes where their endogenous signal (leader) sequence is replaced with a heterologous leader (signal) sequence for another similar enzyme or from a completely different source). The prepro sequence (including a sequence of the invention used as a heterologous prepro domain) can be located on the amino terminal or the carboxy terminal end of the protein.

The invention also includes isolated, synthetic or recombinant signal sequences, prepro sequences and catalytic domains (e.g., "active sites") comprising sequences of the invention. The polypeptide comprising a signal sequence of the invention can be a cellulase, e.g., endoglucanase, cellobiohydrolase, beta-glucosidase, xylanase, mannanse, β-xylosidase, arabinofuranosidase, and/or oligomerase enzyme of the invention or another cellulase, e.g., endoglucanase, cellobiohydrolase, beta-glucosidase, xylanase, mannanse, β-xylosidase, arabinofuranosidase, and/or oligomerase enzyme or another enzyme or other polypeptide. Methods for identifying "prepro" domain sequences and signal sequences are well known in the art, see, e.g., Van de Ven (1993) Crit. Rev. Oncog. 4(2):115-136. For example, to identify a prepro sequence, the protein is purified from the extracellular space and the N-terminal protein sequence is determined and compared to the unprocessed form.

The cellulase, e.g., endoglucanase, cellobiohydrolase, beta-glucosidase, xylanase, mannanse, β-xylosidase, arabinofuranosidase, and/or oligomerase enzyme signal sequences (SPs) and/or prepro sequences of the invention can be isolated, synthetic or recombinant peptides, or, sequences joined to another cellulase, e.g., endoglucanase, cellobiohydrolase, beta-glucosidase, xylanase, mannanse, β-xylosidase, arabinofuranosidase, and/or oligomerase enzyme or a non-cellulase, e.g., non-endoglucanase, non-cellobiohydrolase and/or non-beta-glucosidase polypeptide, e.g., as a fusion (chimeric) protein. In one aspect, the invention provides polypeptides comprising cellulase, e.g., endoglucanase, cellobiohydrolase, beta-glucosidase, xylanase, mannanse, β-xylosidase, arabinofuranosidase, and/or oligomerase enzyme signal sequences of the invention. In one aspect, polypeptides comprising cellulase, e.g., endoglucanase, cellobiohydrolase, beta-glucosidase, xylanase, mannanse, β-xylosidase, arabinofuranosidase, and/or oligomerase enzyme signal sequences SPs and/or prepro of the invention comprise sequences heterologous to a cellulase, e.g., endoglucanase, cellobiohydrolase, beta-glucosidase, xylanase, mannanse, β-xylosidase, arabinofuranosidase, and/or oligomerase enzyme of the invention (e.g., a fusion protein comprising an SP and/or prepro of the invention and sequences from another cellulase, e.g., endoglucanase, cellobiohydrolase, beta-glucosidase, xylanase, mannanse, β-xylosidase, arabinofuranosidase, and/or oligomerase enzyme or a non-cellulase, e.g., non-endoglucanase, non-cellobiohydrolase and/or non-betaglucosidase protein). In one aspect, the invention provides cellulase, e.g., endoglucanase, cellobiohydrolase, beta-glucosidase, xylanase, mannanse, β-xylosidase, arabinofuranosidase, and/or oligomerase enzymes of the invention with heterologous SPs and/or prepro sequences, e.g., sequences with a yeast signal sequence. An oligomerase or a cellulase, e.g., endoglucanase, cellobiohydrolase, beta-glucosidase, xylanase, mannanse, β-xylosidase, arabinofuranosidase, and/or oligomerase enzyme of the invention can comprise a heterologous SP and/or prepro in a vector, e.g., a pPIC series vector (Invitrogen, Carlsbad, Calif.).

In one aspect, SPs and/or prepro sequences of the invention are identified following identification of novel cellulase, e.g., endoglucanase, cellobiohydrolase, beta-glucosidase, xylanase, mannanse, β-xylosidase, arabinofuranosidase, and/or oligomerase polypeptides. The pathways by which proteins are sorted and transported to their proper cellular location are often referred to as protein targeting pathways. One of the most important elements in all of these targeting systems is a short amino acid sequence at the amino terminus of a newly synthesized polypeptide called the signal sequence. This signal sequence directs a protein to its appropriate location in the cell and is removed during transport or when the protein reaches its final destination. Most lysosomal, membrane, or secreted proteins have an amino-terminal signal sequence that marks them for translocation into the lumen of the endoplasmic reticulum. The signal sequences can vary in length from about 10 to 65, or more, amino acid residues. Various methods of recognition of signal sequences are known to those of skill in the art. For example, in one aspect, novel cellulase, e.g., endoglucanase, cellobiohydrolase, beta-glucosidase, xylanase, mannanse, β-xylosidase, arabinofuranosidase, and/or oligomerase enzyme signal peptides are identified by a method referred to as SignalP. SignalP uses a combined neural network which recognizes both signal peptides and their cleavage sites. (Nielsen (1997) "Identification of prokaryotic and eukaryotic signal peptides and prediction of their cleavage sites." Protein Engineering 10:1-6.

In some aspects cellulase, e.g., endoglucanase, cellobiohydrolase, beta-glucosidase, xylanase, mannanse, β-xylosidase, arabinofuranosidase, and/or oligomerase enzymes of the invention do not have SPs and/or prepro sequences or "domains." In one aspect, the invention provides the cellulase, e.g., endoglucanase, cellobiohydrolase, beta-glucosidase, xylanase, mannanse, β-xylosidase, arabinofuranosidase, and/or oligomerase enzymes of the invention lacking all or part of an SP and/or a prepro domain. In one aspect, the invention provides a nucleic acid sequence encoding a signal sequence (SP) and/or prepro from one cellulase, e.g., endoglucanase, cellobiohydrolase, beta-glucosidase, xylanase, mannanse, β-xylosidase, arabinofuranosidase, and/or oligomerase enzyme operably linked to a nucleic acid sequence of a different cellulase, e.g., endoglucanase, cellobiohydrolase, beta-glucosidase, xylanase, mannanse, β-xylosidase, arabinofuranosidase, and/or oligomerase enzyme or, optionally, a signal sequence (SPs) and/or prepro domain from a non-cellulase, e.g., non-endoglucanase, non-cellobiohydrolase and/or non-beta-glucosidase protein may be desired.

The invention also provides isolated, synthetic or recombinant polypeptides comprising signal sequences (SPs), prepro domain and/or catalytic domains (CDs) of the invention and heterologous sequences. The heterologous sequences are sequences not naturally associated (e.g., to a enzyme) with an SP, prepro domain and/or CD. The sequence to which the SP, prepro domain and/or CD are not naturally associated can be on the SP's, prepro domain and/or CD's amino terminal end, carboxy terminal end, and/or on both ends of the SP and/or CD. In one aspect, the invention provides an isolated, synthetic or recombinant polypeptide comprising (or consisting of) a polypeptide comprising a signal sequence (SP), prepro domain and/or catalytic domain (CD) of the invention with the proviso that it is not associated with any sequence to which it is naturally associated (e.g., a cellulase, e.g., endoglucanase, cellobiohydrolase, beta-glucosidase, xylanase, mannanse, β-xylosidase, arabinofuranosidase, and/or oligomerase enzyme sequence). Similarly in one aspect, the invention provides isolated, synthetic or recombinant nucleic acids encoding these polypeptides. Thus, in one aspect, the isolated, synthetic or recombinant nucleic acid of the invention comprises coding sequence for a signal sequence (SP), prepro domain and/or catalytic domain (CD) of the invention and a heterologous sequence (i.e., a sequence not naturally associated with the a signal sequence (SP), prepro domain and/or catalytic domain (CD) of the invention). The heterologous sequence can be on the 3' terminal end, 5' terminal end, and/or on both ends of the SP, prepro domain and/or CD coding sequence.

Hybrid (Chimeric) Cellulase, e.g., Endoglucanase, Cellobiohydrolase and/or Beta-Glucosidase Enzymes and Peptide Libraries In one aspect, the invention provides hybrid cellulase, e.g., endoglucanase, cellobiohydrolase, beta-glucosidase, xylanase, mannanse, β-xylosidase, arabinofuranosidase, and/or oligomerase enzymes and fusion proteins, including peptide libraries, comprising sequences of the invention. The peptide libraries of the invention can be used to isolate peptide modulators (e.g., activators or inhibitors) of targets, such as cellulase, e.g., endoglucanase, cellobiohydrolase, beta-glucosidase, xylanase, mannanse, β-xylosidase, arabinofuranosidase, and/or oligomerase enzyme substrates, receptors, enzymes. The peptide libraries of the invention can be used to identify formal binding partners of targets, such as ligands, e.g., cytokines, hormones and the like. In one aspect, the invention provides chimeric proteins comprising a signal sequence (SP), prepro domain and/or catalytic domain (CD) of the invention or a combination thereof and a heterologous sequence (see above).

In one aspect, the fusion proteins of the invention (e.g., the peptide moiety) are conformationally stabilized (relative to linear peptides) to allow a higher binding affinity for targets. The invention provides fusions of cellulase, e.g., endoglucanase, cellobiohydrolase, beta-glucosidase, xylanase, mannanse, β-xylosidase, arabinofuranosidase, and/or oligomerase enzymes of the invention and other peptides, including known and random peptides. They can be fused in such a manner that the structure of the cellulase, e.g., endoglucanase, cellobiohydrolase, beta-glucosidase, xylanase, mannanse, β-xylosidase, arabinofuranosidase, and/or oligomerase enzymes is not significantly perturbed and the peptide is metabolically or structurally conformationally stabilized. This allows the creation of a peptide library that is easily monitored both for its presence within cells and its quantity.

Amino acid sequence variants of the invention can be characterized by a predetermined nature of the variation, a feature that sets them apart from a naturally occurring form, e.g., an allelic or interspecies variation of a cellulase, e.g., endoglucanase, cellobiohydrolase, beta-glucosidase, xylanase, mannanse, β-xylosidase, arabinofuranosidase, and/or oligomerase enzyme sequence. In one aspect, the variants of the invention exhibit the same qualitative biological activity as the naturally occurring analogue. Alternatively, the variants can be selected for having modified characteristics. In one aspect, while the site or region for introducing an amino acid sequence variation is predetermined, the mutation per se need not be predetermined. For example, in order to optimize the performance of a mutation at a given site, random mutagenesis may be conducted at the target codon or region and the expressed cellulase, e.g., endoglucanase, cellobiohydrolase, beta-glucosidase, xylanase, mannanse, β-xylosidase, arabinofuranosidase, and/or oligomerase enzyme variants screened for the optimal combination of desired activity. Techniques for making substitution mutations at predetermined sites in DNA having a known sequence are well known, as discussed herein for example, M13 primer mutagenesis and PCR mutagenesis. Screening of the mutants can be done using, e.g., assays of glucan hydrolysis. In alternative aspects, amino acid substitutions can be single residues; insertions can be on the order of from about 1 to 20 amino acids, although considerably larger insertions can be done. Deletions can range from about 1 to about 20, 30, 40, 50, 60, 70 residues or more. To obtain a final derivative with the optimal properties, substitutions, deletions, insertions or any combination thereof may be used. Generally, these changes are done on a few amino acids to minimize the alteration of the molecule. However, larger changes may be tolerated in certain circumstances.

The invention provides cellulase, e.g., endoglucanase, cellobiohydrolase, beta-glucosidase, xylanase, mannanse, β-xylosidase, arabinofuranosidase, and/or oligomerase enzymes where the structure of the polypeptide backbone, the secondary or the tertiary structure, e.g., an alpha-helical or beta-sheet structure, has been modified. In one aspect, the charge or hydrophobicity has been modified. In one aspect, the bulk of a side chain has been modified. Substantial changes in function or immunological identity are made by selecting substitutions that are less conservative. For example, substitutions can be made which more significantly affect: the structure of the polypeptide backbone in the area of the alteration, for example a alpha-helical or a beta-sheet structure; a charge or a hydrophobic site of the molecule, which can be at an active site; or a side chain. The invention provides substitutions in polypeptide of the invention where (a) a hydrophilic residues, e.g. seryl or threonyl, is substituted for (or by) a hydrophobic residue, e.g. leucyl, isoleucyl, phenylalanyl, valyl or alanyl; (b) a cysteine or proline is substituted for (or by) any other residue; (c) a residue having an electropositive side chain, e.g. lysyl, arginyl, or histidyl, is substituted for (or by) an electronegative residue, e.g. glutamyl or aspartyl; or (d) a residue having a bulky side chain, e.g. phenylalanine, is substituted for (or by) one not having a side chain, e.g. glycine. The variants can exhibit the same qualitative biological activity (i.e., a cellulase, e.g., endoglucanase, cellobiohydrolase, beta-glucosidase, xylanase, mannanse, β-xylosidase, arabinofuranosidase, and/or oligomerase enzyme activity) although variants can be selected to modify the characteristics of the cellulase, e.g., endoglucanase, cellobiohydrolase, beta-glucosidase, xylanase, mannanse, β-xylosidase, arabinofuranosidase, and/or oligomerase enzymes as needed.

In one aspect, cellulase, e.g., endoglucanase, cellobiohydrolase, beta-glucosidase, xylanase, mannanse, β-xylosidase, arabinofuranosidase, and/or oligomerase enzymes of the invention comprise epitopes or purification tags, signal sequences or other fusion sequences, etc. In one aspect, the cellulase, e.g., endoglucanase, cellobiohydrolase, beta-glucosidase, xylanase, mannanse, β-xylosidase, arabinofuranosidase, and/or oligomerase enzymes of the invention can be fused to a random peptide to form a fusion polypeptide. By "fused" or "operably linked" herein is meant that the random peptide and the cellulase, e.g., endoglucanase, cellobiohydrolase, beta-glucosidase, xylanase, mannanse, β-xylosidase, arabinofuranosidase, and/or oligomerase enzyme are linked together, in such a manner as to minimize the disruption to the stability of the cellulase, e.g., endoglucanase, cellobiohydrolase, beta-glucosidase, xylanase, mannanse, β-xylosidase, arabinofuranosidase, and/or oligomerase enzyme structure, e.g., it retains cellulase, e.g., endoglucanase, cellobiohydrolase, beta-glucosidase, xylanase, mannanse, β-xylosidase, arabinofuranosidase, and/or oligomerase enzyme activity. The fusion polypeptide (or fusion polynucleotide encoding the fusion polypeptide) can comprise further components as well, including multiple peptides at multiple loops.

In one aspect, the peptides and nucleic acids encoding them are randomized, either fully randomized or they are biased in their randomization, e.g. in nucleotide/residue frequency generally or per position. "Randomized" means that each nucleic acid and peptide consists of essentially random nucleotides and amino acids, respectively. In one aspect, the nucleic acids which give rise to the peptides can be chemically synthesized, and thus may incorporate any nucleotide at any position. Thus, when the nucleic acids are expressed to form peptides, any amino acid residue may be incorporated at any position. The synthetic process can be designed to generate randomized nucleic acids, to allow the formation of all or most of the possible combinations over the length of the nucleic acid, thus forming a library of randomized nucleic acids. The library can provide a sufficiently structurally diverse population of randomized expression products to affect a probabilistically sufficient range of cellular responses to provide one or more cells exhibiting a desired response. Thus, the invention provides an interaction library large enough so that at least one of its members will have a structure that gives it affinity for some molecule, protein, or other factor.

In one aspect, a cellulase, e.g., endoglucanase, cellobiohydrolase, beta-glucosidase, xylanase, mannanse, β-xylosidase, arabinofuranosidase, and/or oligomerase enzyme of the invention is a multidomain enzyme that comprises a signal peptide, a carbohydrate binding module, a cellulase, e.g., endoglucanase, cellobiohydrolase, beta-glucosidase, xylanase, mannanse, β-xylosidase, arabinofuranosidase, and/or oligomerase enzyme catalytic domain, a linker and/or another catalytic domain.

The invention provides a methods and sequences for generating chimeric polypeptides which may encode biologically active hybrid polypeptides (e.g., hybrid cellulase, e.g., endoglucanase, cellobiohydrolase, beta-glucosidase, xylanase, mannanse, β-xylosidase, arabinofuranosidase, and/or oligomerase enzymes). In one aspect, the original polynucleotides (e.g., an exemplary nucleic acid of the invention) encode biologically active polypeptides. In one aspect, a method of the invention produces new hybrid polypeptides by utilizing cellular processes which integrate the sequence of the original polynucleotides such that the resulting hybrid polynucleotide encodes a polypeptide demonstrating activities derived, but different, from the original biologically active polypeptides (e.g., cellulase or antibody of the invention). For example, the original polynucleotides may encode a particular enzyme (e.g., cellulase) from or found in different microorganisms. An enzyme encoded by a first polynucleotide from one organism or variant may, for example, function effectively under a particular environmental condition, e.g. high salinity. An enzyme encoded by a second polynucleotide from a different organism or variant may function effectively under a different environmental condition, such as extremely high temperatures. A hybrid polynucleotide containing sequences from the first and second original polynucleotides may encode an enzyme which exhibits characteristics of both enzymes encoded by the original polynucleotides. Thus, the enzyme encoded by the hybrid polynucleotide of the invention may function effectively under environmental conditions shared by each of the enzymes encoded by the first and second polynucleotides, e.g., high salinity and extreme temperatures.

In one aspect, a hybrid polypeptide generated by a method of the invention may exhibit specialized enzyme activity not displayed in the original enzymes. For example, following recombination and/or reductive reassortment of polynucleotides encoding cellulase, e.g., endoglucanase, cellobiohydrolase, beta-glucosidase, xylanase, mannanse, β-xylosidase, arabinofuranosidase, and/or oligomerase enzymes, the resulting hybrid polypeptide encoded by a hybrid polynucleotide can be screened for specialized non-cellulase, e.g., non-endoglucanase, non-cellobiohydrolase and/or non-beta-glucosidase enzyme activities, e.g., hydrolase, peptidase, phosphorylase, etc., activities, obtained from each of the original enzymes. In one aspect, the hybrid polypeptide is screened to ascertain those chemical functionalities which distinguish the hybrid polypeptide from the original parent polypeptides, such as the temperature, pH or salt concentration at which the hybrid polypeptide functions.

In one aspect, the invention relates to a method for producing a biologically active hybrid polypeptide and screening such a polypeptide for enhanced activity by:
1) introducing at least a first polynucleotide in operable linkage and a second polynucleotide in operable linkage, the at least first polynucleotide and second polynucleotide sharing at least one region of partial sequence homology, into a suitable host cell;
2) growing the host cell under conditions which promote sequence reorganization resulting in a hybrid polynucleotide in operable linkage;
3) expressing a hybrid polypeptide encoded by the hybrid polynucleotide;
4) screening the hybrid polypeptide under conditions which promote identification of enhanced biological activity; and
5) isolating the a polynucleotide encoding the hybrid polypeptide.

Isolating and Discovering Cellulase Enzymes

The invention provides methods for isolating and discovering cellulases, e.g., endoglucanase, cellobiohydrolase, beta-glucosidase, xylanase, mannanse, β-xylosidase, arabinofuranosidase, and/or oligomerase enzymes and the nucleic acids that encode them. Polynucleotides or enzymes may be isolated from individual organisms ("isolates"), collections of organisms that have been grown in defined media ("enrichment cultures"), or, uncultivated organisms ("environmental samples"). The organisms can be isolated by, e.g., in vivo biopanning (see discussion, below). The use of a culture-independent approach to derive polynucleotides encoding novel bioactivities from environmental samples is most preferable since it allows one to access untapped resources of biodiversity. Polynucleotides or enzymes also can be isolated from any one of numerous organisms, e.g. bacteria. In addition to whole cells, polynucleotides or enzymes also can be isolated from crude enzyme preparations derived from cultures of these organisms, e.g., bacteria.

"Environmental libraries" are generated from environmental samples and represent the collective genomes of naturally occurring organisms archived in cloning vectors that can be propagated in suitable prokaryotic hosts. Because the cloned DNA is initially extracted directly from environmental samples, the libraries are not limited to the small fraction of prokaryotes that can be grown in pure culture. Additionally, a normalization of the environmental DNA present in these samples could allow more equal representation of the DNA from all of the species present in the original sample. This can dramatically increase the efficiency of finding interesting genes from minor constituents of the sample which may be under-represented by several orders of magnitude compared to the dominant species.

In one aspect, gene libraries generated from one or more uncultivated microorganisms are screened for an activity of interest. Potential pathways encoding bioactive molecules of interest are first captured in prokaryotic cells in the form of gene expression libraries. In one aspect, polynucleotides encoding activities of interest are isolated from such libraries and introduced into a host cell. The host cell is grown under conditions which promote recombination and/or reductive reassortment creating potentially active biomolecules with novel or enhanced activities.

In vivo biopanning may be performed utilizing a FACS-based and non-optical (e.g., magnetic) based machines. In one aspect, complex gene libraries are constructed with vectors which contain elements which stabilize transcribed RNA. For example, the inclusion of sequences which result in secondary structures such as hairpins which are designed to flank the transcribed regions of the RNA would serve to enhance their stability, thus increasing their half life within the cell. The probe molecules used in the biopanning process consist of oligonucleotides labeled with reporter molecules that only fluoresce upon binding of the probe to a target molecule. These probes are introduced into the recombinant cells from the library using one of several transformation methods. The probe molecules bind to the transcribed target mRNA resulting in DNA/RNA heteroduplex molecules. Binding of the probe to a target will yield a fluorescent signal which is detected and sorted by the FACS machine during the screening process.

In one aspect, subcloning is performed to further isolate sequences of interest. In subcloning, a portion of DNA is amplified, digested, generally by restriction enzymes, to cut out the desired sequence, the desired sequence is ligated into a recipient vector and is amplified. At each step in subcloning, the portion is examined for the activity of interest, in order to ensure that DNA that encodes the structural protein has not been excluded. The insert may be purified at any step of the subcloning, for example, by gel electrophoresis prior to ligation into a vector or where cells containing the recipient vector and cells not containing the recipient vector are placed on selective media containing, for example, an antibiotic, which will kill the cells not containing the recipient vector. Specific methods of subcloning cDNA inserts into vectors are well-known in the art (Sambrook et al., Molecular Cloning: A Laboratory Manual, 2nd Ed., Cold Spring Harbor Laboratory Press (1989)). In another aspect, the enzymes of the invention are subclones. Such subclones may differ from the parent clone by, for example, length, a mutation, a tag or a label.

The microorganisms from which the polynucleotide may be discovered, isolated or prepared include prokaryotic microorganisms, such as Eubacteria and Archaebacteria and lower eukaryotic microorganisms such as fungi, some algae and protozoa. Polynucleotides may be discovered, isolated or prepared from samples, e.g. environmental samples, in which case the nucleic acid may be recovered without culturing of an organism or recovered from one or more cultured organisms. In one aspect, such microorganisms may be extremophiles, such as hyperthermophiles, psychrophiles, psychrotrophs, halophiles, barophiles and acidophiles. Polynucleotides encoding enzymes isolated from extremophilic microorganisms can be used. Enzymes of this invention can function at temperatures above 100° C., e.g., as those found in terrestrial hot springs and deep sea thermal vents, or at temperatures below 0° C., e.g., as those found in arctic waters, in a saturated salt environment, e.g., as those found in the Dead Sea, at pH values around 0, e.g., as those found in coal deposits and geothermal sulfur-rich springs, or at pH values greater than 11, e.g., as those found in sewage sludge. In one aspect, enzymes of the invention have high activity throughout a wide range of temperatures and pHs.

Polynucleotides selected and isolated as hereinabove described are introduced into a suitable host cell. A suitable host cell is any cell which is capable of promoting recombination and/or reductive reassortment. The selected polynucleotides are in one aspect already in a vector which includes appropriate control sequences. The host cell can be a higher eukaryotic cell, such as a mammalian cell, or a lower eukaryotic cell, such as a yeast cell, or in one aspect, the host cell can be a prokaryotic cell, such as a bacterial cell. Introduction of the construct into the host cell can be effected by calcium phosphate transfection, DEAE-Dextran mediated transfection, or electroporation.

Exemplary hosts include bacterial cells, such as E. coli, Streptomyces, Salmonella typhimurium; fungal cells, such as yeast; insect cells such as Drosophila S2 and Spodoptera Sf9; animal cells such as CHO, COS or Bowes melanoma; adenoviruses; and plant cells; see discussion, above. The selection of an appropriate host is deemed to be within the scope of those skilled in the art from the teachings herein.

Various mammalian cell culture systems can be employed to express recombinant protein; examples of mammalian expression systems include the COS-7 lines of monkey kidney fibroblasts, described in "SV40-transformed simian cells support the replication of early SV40 mutants" (Gluzman, 1981) and other cell lines capable of expressing a compatible vector, for example, the C127, 3T3, CHO, HeLa and BHK cell lines. Mammalian expression vectors can comprise an origin of replication, a suitable promoter and enhancer and also any necessary ribosome binding sites, polyadenylation site, splice donor and acceptor sites, transcriptional termination sequences and 5' flanking nontranscribed sequences. DNA sequences derived from the SV40 splice and polyadenylation sites may be used to provide the required nontranscribed genetic elements.

In another aspect, nucleic acids, polypeptides and methods of the invention are used in biochemical pathways, or to generate novel polynucleotides encoding biochemical pathways from one or more operons or gene clusters or portions thereof. For example, bacteria and many eukaryotes have a coordinated mechanism for regulating genes whose products are involved in related processes. The genes are clustered, in structures referred to as "gene clusters," on a single chromosome and are transcribed together under the control of a single regulatory sequence, including a single promoter which initiates transcription of the entire cluster. Thus, a gene cluster is a group of adjacent genes that are either identical or related, usually as to their function (an example of a biochemical pathway encoded by gene clusters are polyketides).

In one aspect, gene cluster DNA is isolated from different organisms and ligated into vectors, e.g., vectors containing expression regulatory sequences which can control and regulate the production of a detectable protein or protein-related array activity from the ligated gene clusters. Use of vectors which have an exceptionally large capacity for exogenous DNA introduction can be appropriate for use with such gene clusters and are described by way of example herein to include the f-factor (or fertility factor) of E. coli. This f-factor of E. coli is a plasmid which affects high-frequency transfer of itself during conjugation and is ideal to achieve and stably propagate large DNA fragments, such as gene clusters from mixed microbial samples. One aspect is to use cloning vectors, referred to as "fosmids" or bacterial artificial chromosome (BAC) vectors. These are derived from E. coli f-factor which is able to stably integrate large segments of genomic DNA. When integrated with DNA from a mixed uncultured environmental sample, this makes it possible to achieve large genomic fragments in the form of a stable "environmental DNA library." Another type of vector for use in the present invention is a cosmid vector. Cosmid vectors were originally designed to clone and propagate large segments of genomic DNA. Cloning into cosmid vectors is described in detail in Sambrook et al., Molecular Cloning: A Laboratory Manual, 2nd Ed., Cold Spring Harbor Laboratory Press (1989). Once ligated into an appropriate vector, two or more vectors containing different polyketide synthase gene clusters can be introduced into a suitable host cell. Regions of partial sequence homology shared by the gene clusters will promote processes which result in sequence reorganization resulting in a hybrid gene cluster. The novel hybrid gene cluster can then be screened for enhanced activities not found in the original gene clusters.

Methods for screening for various enzyme activities are known to those of skill in the art and are discussed throughout the present specification, see, e.g., Examples 1, 2 and 3, below. Such methods may be employed when isolating the polypeptides and polynucleotides of the invention.

In one aspect, the invention provides methods for discovering and isolating cellulases, e.g., endoglucanase, cellobiohydrolase, beta-glucosidase, xylanase, mannanse, β-xylosidase, arabinofuranosidase, and/or oligomerase, or compounds to modify the activity of these enzymes, using a whole cell approach (see discussion, below): clones encoding cellulase, e.g., endoglucanase, cellobiohydrolase, beta-glucosidase, xylanase, mannanse, β-xylosidase, arabinofuranosidase, and/or oligomerase from genomic DNA library can be screened.

Screening Methodologies and "On-Line" Monitoring Devices

In practicing the methods of the invention, a variety of apparatus and methodologies can be used to in conjunction with the polypeptides and nucleic acids of the invention, e.g., to screen polypeptides for cellulase, e.g., endoglucanase, cellobiohydrolase, beta-glucosidase, xylanase, mannanse, β-xylosidase, arabinofuranosidase, and/or oligomerase enzyme activity, to screen compounds as potential modulators, e.g., activators or inhibitors, of a cellulase, e.g., endoglucanase, cellobiohydrolase, beta-glucosidase, xylanase, mannanse, β-xylosidase, arabinofuranosidase, and/or oligomerase enzyme activity, for antibodies that bind to a polypeptide of the invention, for nucleic acids that hybridize to a nucleic acid of the invention, to screen for cells expressing a polypeptide of the invention and the like. In addition to the array formats described in detail below for screening samples, alternative formats can also be used to practice the methods of the invention. Such formats include, for example, mass spectrometers, chromatographs, e.g., high-throughput HPLC and other forms of liquid chromatography, and smaller formats, such as 1536-well plates, 384-well plates and so on. High throughput screening apparatus can be adapted and used to practice the methods of the invention, see, e.g., U.S. Patent Application Nos. 20020001809; 20050272044.

Capillary Arrays

Nucleic acids or polypeptides of the invention can be immobilized to or applied to an array. Arrays can be used to screen for or monitor libraries of compositions (e.g., small molecules, antibodies, nucleic acids, etc.) for their ability to bind to or modulate the activity of a nucleic acid or a polypeptide of the invention. Capillary arrays, such as the GIGAMATRIX™, Diversa Corporation, San Diego, Calif.; and arrays described in, e.g., U.S. Patent Application No. 20020080350 A1; WO 0231203 A; WO 0244336 A, provide an alternative apparatus for holding and screening samples. In one aspect, the capillary array includes a plurality of capillaries formed into an array of adjacent capillaries, wherein each capillary comprises at least one wall defining a lumen for retaining a sample. The lumen may be cylindrical, square, hexagonal or any other geometric shape so long as the walls form a lumen for retention of a liquid or sample. The capillaries of the capillary array can be held together in close proximity to form a planar structure. The capillaries can be bound together, by being fused (e.g., where the capillaries are made of glass), glued, bonded, or clamped side-by-side. Additionally, the capillary array can include interstitial material disposed between adjacent capillaries in the array, thereby forming a solid planar device containing a plurality of through-holes.

A capillary array can be formed of any number of individual capillaries, for example, a range from 100 to 4,000,000 capillaries. Further, a capillary array having about 100,000 or more individual capillaries can be formed into the standard size and shape of a Microtiter® plate for fitment into standard laboratory equipment. The lumens are filled manually or automatically using either capillary action or microinjection using a thin needle. Samples of interest may subsequently be removed from individual capillaries for further analysis or characterization. For example, a thin, needle-like probe is positioned in fluid communication with a selected capillary to either add or withdraw material from the lumen.

In a single-pot screening assay, the assay components are mixed yielding a solution of interest, prior to insertion into the capillary array. The lumen is filled by capillary action when at least a portion of the array is immersed into a solution of interest. Chemical or biological reactions and/or activity in each capillary are monitored for detectable events. A detectable event is often referred to as a "hit", which can usually be distinguished from "non-hit" producing capillaries by optical detection. Thus, capillary arrays allow for massively parallel detection of "hits".

In a multi-pot screening assay, a polypeptide or nucleic acid, e.g., a ligand, can be introduced into a first component, which is introduced into at least a portion of a capillary of a capillary array. An air bubble can then be introduced into the capillary behind the first component. A second component can then be introduced into the capillary, wherein the second component is separated from the first component by the air bubble. The first and second components can then be mixed by applying hydrostatic pressure to both sides of the capillary array to collapse the bubble. The capillary array is then monitored for a detectable event resulting from reaction or non-reaction of the two components.

In a binding screening assay, a sample of interest can be introduced as a first liquid labeled with a detectable particle into a capillary of a capillary array, wherein the lumen of the capillary is coated with a binding material for binding the detectable particle to the lumen. The first liquid may then be removed from the capillary tube, wherein the bound detectable particle is maintained within the capillary, and a second liquid may be introduced into the capillary tube. The capillary is then monitored for a detectable event resulting from reaction or non-reaction of the particle with the second liquid.

Arrays, or "Biochips"

Nucleic acids or polypeptides of the invention can be immobilized to or applied to an array. Arrays can be used to screen for or monitor libraries of compositions (e.g., small molecules, antibodies, nucleic acids, etc.) for their ability to bind to or modulate the activity of a nucleic acid or a polypeptide of the invention. For example, in one aspect of the invention, a monitored parameter is transcript expression of a cellulase, e.g., endoglucanase, cellobiohydrolase, beta-glucosidase, xylanase, mannanse, β-xylosidase, arabinofuranosidase, and/or oligomerase enzyme gene. One or more, or, all the transcripts of a cell can be measured by hybridization of a sample comprising transcripts of the cell, or, nucleic acids representative of or complementary to transcripts of a cell, by hybridization to immobilized nucleic acids on an array, or "biochip." By using an "array" of nucleic acids on a microchip, some or all of the transcripts of a cell can be simultaneously quantified. Alternatively, arrays comprising genomic nucleic acid can also be used to determine the genotype of a newly engineered strain made by the methods of the invention. Polypeptide arrays" can also be used to simultaneously quantify a plurality of proteins. The present invention can be practiced with any known "array," also referred to as a "microarray" or "nucleic acid array" or "polypeptide array" or "antibody array" or "biochip," or variation thereof. Arrays are generically a plurality of "spots" or "target elements," each target element comprising a defined amount of one or more biological molecules, e.g., oligonucleotides, immobilized onto a defined area of a substrate surface for specific binding to a sample molecule, e.g., mRNA transcripts.

The terms "array" or "microarray" or "biochip" or "chip" as used herein is a plurality of target elements, each target element comprising a defined amount of one or more polypeptides (including antibodies) or nucleic acids immobilized onto a defined area of a substrate surface, as discussed in further detail, below.

In practicing the methods of the invention, any known array and/or method of making and using arrays can be incorporated in whole or in part, or variations thereof, as described, for example, in U.S. Pat. Nos. 6,277,628; 6,277,489; 6,261,776; 6,258,606; 6,054,270; 6,048,695; 6,045,996; 6,022,963; 6,013,440; 5,965,452; 5,959,098; 5,856,174; 5,830,645; 5,770,456; 5,632,957; 5,556,752; 5,143,854; 5,807,522; 5,800,992; 5,744,305; 5,700,637; 5,556,752; 5,434,049; see also, e.g., WO 99/51773; WO 99/09217; WO 97/46313; WO 96/17958; see also, e.g., Johnston (1998) Curr. Biol. 8:R171-R174; Schummer (1997) Biotechniques 23:1087-1092; Kern (1997) Biotechniques 23:120-124; Solinas-Toldo (1997) Genes, Chromosomes & Cancer 20:399-407; Bowtell (1999) Nature Genetics Supp. 21:25-32. See also published U.S. patent applications Nos. 20010018642; 20010019827; 20010016322; 20010014449; 20010014448; 20010012537; 20010008765.

Antibodies and Antibody-Based Screening Methods

The invention provides isolated, synthetic or recombinant antibodies that specifically bind to a cellulase, e.g., endoglucanase, cellobiohydrolase, beta-glucosidase, xylanase, mannanse, β-xylosidase, arabinofuranosidase, and/or oligomerase enzyme of the invention. These antibodies can be used to isolate, identify or quantify the cellulase, e.g., endoglucanase, cellobiohydrolase, beta-glucosidase, xylanase, mannanse, β-xylosidase, arabinofuranosidase, and/or oligomerase enzymes of the invention or related polypeptides. These antibodies can be used to isolate other polypeptides within the scope the invention or other related cellulase, e.g., endoglucanase, cellobiohydrolase, beta-glucosidase, xylanase, mannanse, β-xylosidase, arabinofuranosidase, and/or oligomerase enzymes. The antibodies can be designed to bind to an active site of a cellulase, e.g., endoglucanase, cellobiohydrolase, beta-glucosidase, xylanase, mannanse, β-xylosidase, arabinofuranosidase, and/or oligomerase enzyme. Thus, the invention provides methods of inhibiting cellulase, e.g., endoglucanase, cellobiohydrolase, beta-glucosidase, xylanase, mannanse, β-xylosidase, arabinofuranosidase, and/or oligomerase enzymes using the antibodies of the invention (see discussion above regarding applications for anti-cellulase, e.g., anti-endoglucanase, anti-cellobiohydrolase and/or anti-beta-glucosidase enzyme compositions of the invention).

The term "antibody" includes a peptide or polypeptide derived from, modeled after or substantially encoded by an immunoglobulin gene or immunoglobulin genes, or fragments thereof, capable of specifically binding an antigen or epitope, see, e.g. Fundamental Immunology, Third Edition, W. E. Paul, ed., Raven Press, N.Y. (1993); Wilson (1994) J. Immunol. Methods 175:267-273; Yarmush (1992) J. Biochem. Biophys. Methods 25:85-97. The term antibody includes antigen-binding portions, i.e., "antigen binding sites," (e.g., fragments, subsequences, complementarity determining regions (CDRs)) that retain capacity to bind antigen, including (i) a Fab fragment, a monovalent fragment consisting of the VL, VH, CL and CH1 domains; (ii) a F(ab')2 fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) Nature 341:544-546), which consists of a VH domain; and (vi) an isolated complementarity determining region (CDR). Single chain antibodies are also included by reference in the term "antibody."

The invention provides fragments of the enzymes of the invention (e.g., peptides) including immunogenic fragments (e.g., subsequences) of a polypeptide of the invention. The invention provides compositions comprising a polypeptide or peptide of the invention and adjuvants or carriers and the like.

The antibodies can be used in immunoprecipitation, staining, immunoaffinity columns, and the like. If desired, nucleic acid sequences encoding for specific antigens can be generated by immunization followed by isolation of polypeptide or nucleic acid, amplification or cloning and immobilization of polypeptide onto an array of the invention. Alternatively, the methods of the invention can be used to modify the structure of an antibody produced by a cell to be modified, e.g., an antibody's affinity can be increased or decreased. Furthermore, the ability to make or modify antibodies can be a phenotype engineered into a cell by the methods of the invention.

Methods of immunization, producing and isolating antibodies (polyclonal and monoclonal) are known to those of skill in the art and described in the scientific and patent literature, see, e.g., Coligan, CURRENT PROTOCOLS IN IMMUNOLOGY, Wiley/Greene, NY (1991); Stites (eds.) BASIC AND CLINICAL IMMUNOLOGY (7th ed.) Lange Medical Publications, Los Altos, Calif. ("Stites"); Goding, MONOCLONAL ANTIBODIES: PRINCIPLES AND PRACTICE (2d ed.) Academic Press, New York, N.Y. (1986); Kohler (1975) Nature 256:495; Harlow (1988) ANTIBODIES, A LABORATORY MANUAL, Cold Spring Harbor Publications, New York. Antibodies also can be generated in vitro, e.g., using recombinant antibody binding site expressing phage display libraries, in addition to the traditional in vivo methods using animals. See, e.g., Hoogenboom (1997) Trends Biotechnol. 15:62-70; Katz (1997) Annu. Rev. Biophys. Biomol. Struct. 26:27-45.

The polypeptides of the invention or fragments comprising at least 5, 10, 15, 20, 25, 30, 35, 40, 50, 75, 100, or 150 consecutive amino acids thereof, may also be used to generate antibodies which bind specifically to the polypeptides or fragments. The resulting antibodies may be used in immunoaffinity chromatography procedures to isolate or purify the polypeptide or to determine whether the polypeptide is present in a biological sample. In such procedures, a protein preparation, such as an extract, or a biological sample is contacted with an antibody capable of specifically binding to one of the polypeptides of the invention, or fragments comprising at least 5, 10, 15, 20, 25, 30, 35, 40, 50, 75, 100, or 150 consecutive amino acids thereof.

In immunoaffinity procedures, the antibody is attached to a solid support, such as a bead or other column matrix. The protein preparation is placed in contact with the antibody under conditions in which the antibody specifically binds to one of the polypeptides of the invention, or fragment thereof. After a wash to remove non-specifically bound proteins, the specifically bound polypeptides are eluted.

The ability of proteins in a biological sample to bind to the antibody may be determined using any of a variety of procedures familiar to those skilled in the art. For example, binding may be determined by labeling the antibody with a detectable label such as a fluorescent agent, an enzymatic label, or a radioisotope. Alternatively, binding of the antibody to the sample may be detected using a secondary antibody having such a detectable label thereon. Particular assays include ELISA assays, sandwich assays, radioimmunoassays and Western Blots.

Polyclonal antibodies generated against the polypeptides of the invention, or fragments comprising at least 5, 10, 15, 20, 25, 30, 35, 40, 50, 75, 100, or 150 consecutive amino acids thereof can be obtained by direct injection of the polypeptides into an animal or by administering the polypeptides to an animal, for example, a nonhuman. The antibody so obtained can bind the polypeptide itself. In this manner, even a sequence encoding only a fragment of the polypeptide can be used to generate antibodies which may bind to the whole native polypeptide. Such antibodies can then be used to isolate the polypeptide from cells expressing that polypeptide.

For preparation of monoclonal antibodies, any technique which provides antibodies produced by continuous cell line cultures can be used. Examples include the hybridoma technique (Kohler and Milstein, Nature, 256:495-497, 1975), the trioma technique, the human B-cell hybridoma technique (Kozbor et al., Immunology Today 4:72, 1983) and the EBV-hybridoma technique (Cole, et al., 1985, in Monoclonal Antibodies and Cancer Therapy, Alan R. Liss, Inc., pp. 77-96).

Techniques described for the production of single chain antibodies (U.S. Pat. No. 4,946,778) can be adapted to produce single chain antibodies to the polypeptides of the invention, or fragments comprising at least 5, 10, 15, 20, 25, 30, 35, 40, 50, 75, 100, or 150 consecutive amino acids thereof. Alternatively, transgenic mice may be used to express humanized antibodies to these polypeptides or fragments thereof.

Antibodies generated against the polypeptides of the invention, or fragments comprising at least 5, 10, 15, 20, 25, 30, 35, 40, 50, 75, 100, or 150 consecutive amino acids thereof may be used in screening for similar polypeptides from other organisms and samples. In such techniques, polypeptides from the organism are contacted with the antibody and those polypeptides which specifically bind the antibody are detected. Any of the procedures described above may be used to detect antibody binding. One such screening assay is described in "Methods for Measuring Cellulase Activities", *Methods in Enzymology*, Vol 160, pp. 87-116.

Kits

The invention provides kits comprising the compositions, e.g., nucleic acids, expression cassettes, vectors, cells, transgenic seeds or plants or plant parts, polypeptides (e.g., a cellulase enzyme) and/or antibodies of the invention. The kits also can contain instructional material teaching the methodologies and industrial, medical and dietary uses of the invention, as described herein.

Whole Cell Engineering and Measuring Metabolic Parameters

The methods of the invention provide whole cell evolution, or whole cell engineering, of a cell to develop a new cell strain having a new phenotype, e.g., a new or modified cellulase, e.g., endoglucanase, cellobiohydrolase, beta-glucosidase, xylanase, mannanse, β-xylosidase, arabinofuranosidase, and/or oligomerase enzyme activity, by modifying the genetic composition of the cell. See U.S. patent application no. 20040033975.

The genetic composition can be modified by addition to the cell of a nucleic acid of the invention, e.g., a coding sequence for an enzyme of the invention. See, e.g., WO0229032; WO0196551.

To detect the new phenotype, at least one metabolic parameter of a modified cell is monitored in the cell in a "real time" or "on-line" time frame. In one aspect, a plurality of cells, such as a cell culture, is monitored in "real time" or "on-line." In one aspect, a plurality of metabolic parameters is monitored in "real time" or "on-line." Metabolic parameters can be monitored using the cellulase, e.g., endoglucanase, cellobiohydrolase, beta-glucosidase, xylanase, mannanse, β-xylosidase, arabinofuranosidase, and/or oligomerase enzymes of the invention.

Metabolic flux analysis (MFA) is based on a known biochemistry framework. A linearly independent metabolic matrix is constructed based on the law of mass conservation and on the pseudo-steady state hypothesis (PSSH) on the intracellular metabolites. In practicing the methods of the invention, metabolic networks are established, including the:

identity of all pathway substrates, products and intermediary metabolites identity of all the chemical reactions interconverting the pathway metabolites, the stoichiometry of the pathway reactions, identity of all the enzymes catalyzing the reactions, the enzyme reaction kinetics, the regulatory interactions between pathway components, e.g. allosteric interactions, enzyme-enzyme interactions etc, intracellular compartmentalization of enzymes or any other supramolecular organization of the enzymes, and, the presence of any concentration gradients of metabolites, enzymes or effector molecules or diffusion barriers to their movement.

Once the metabolic network for a given strain is built, mathematic presentation by matrix notion can be introduced to estimate the intracellular metabolic fluxes if the on-line metabolome data is available. Metabolic phenotype relies on the changes of the whole metabolic network within a cell. Metabolic phenotype relies on the change of pathway utilization with respect to environmental conditions, genetic regulation, developmental state and the genotype, etc. In one aspect of the methods of the invention, after the on-line MFA calculation, the dynamic behavior of the cells, their phenotype and other properties are analyzed by investigating the pathway utilization. For example, if the glucose supply is increased and the oxygen decreased during the yeast fermentation, the utilization of respiratory pathways will be reduced and/or stopped, and the utilization of the fermentative pathways will dominate. Control of physiological state of cell cultures will become possible after the pathway analysis. The methods of the invention can help determine how to manipulate the fermentation by determining how to change the substrate supply, temperature, use of inducers, etc. to control the physiological state of cells to move along desirable direction. In practicing the methods of the invention, the MFA results can also be compared with transcriptome and proteome data to design experiments and protocols for metabolic engineering or gene shuffling, etc.

In practicing the methods of the invention, any modified or new phenotype can be conferred and detected, including new or improved characteristics in the cell. Any aspect of metabolism or growth can be monitored.

Monitoring Expression of an mRNA Transcript

In one aspect of the invention, the engineered phenotype comprises increasing or decreasing the expression of an mRNA transcript (e.g., a cellulase, e.g., endoglucanase, cellobiohydrolase, beta-glucosidase, xylanase, mannanse, β-xylosidase, arabinofuranosidase, and/or oligomerase enzyme message) or generating new (e.g., cellulase, e.g., endoglucanase, cellobiohydrolase, beta-glucosidase, xylanase, mannanse, β-xylosidase, arabinofuranosidase, and/or oligomerase enzyme) transcripts in a cell. This increased or decreased expression can be traced by testing for the presence of a cellulase, e.g., endoglucanase, cellobiohydrolase, beta-glucosidase, xylanase, mannanse, β-xylosidase, arabinofuranosidase, and/or oligomerase enzyme of the invention or by cellulase, e.g., endoglucanase, cellobiohydrolase, beta-glucosidase, xylanase, mannanse, β-xylosidase, arabinofuranosidase, and/or oligomerase enzyme activity assays. mRNA transcripts, or messages, also can be detected and quantified by any method known in the art, including, e.g., Northern blots, quantitative amplification reactions, hybridization to arrays, and the like. Quantitative amplification reactions include, e.g., quantitative PCR, including, e.g., quantitative reverse transcription polymerase chain reaction, or RT-PCR; quantitative real time RT-PCR, or "real-time kinetic RT-PCR" (see, e.g., Kreuzer (2001) Br. J. Haematol. 114: 313-318; Xia (2001) Transplantation 72:907-914).

In one aspect of the invention, the engineered phenotype is generated by knocking out expression of a homologous gene. The gene's coding sequence or one or more transcriptional control elements can be knocked out, e.g., promoters or enhancers. Thus, the expression of a transcript can be completely ablated or only decreased.

In one aspect of the invention, the engineered phenotype comprises increasing the expression of a homologous gene. This can be effected by knocking out of a negative control element, including a transcriptional regulatory element acting in cis- or trans-, or, mutagenizing a positive control element. One or more, or, all the transcripts of a cell can be measured by hybridization of a sample comprising transcripts of the cell, or, nucleic acids representative of or complementary to transcripts of a cell, by hybridization to immobilized nucleic acids on an array.

Monitoring Expression of a Polypeptides, Peptides and Amino Acids

In one aspect of the invention, the engineered phenotype comprises increasing or decreasing the expression of a polypeptide (e.g., a cellulase, e.g., endoglucanase, cellobiohydrolase, beta-glucosidase, xylanase, mannanse, β-xylosidase, arabinofuranosidase, and/or oligomerase enzyme) or generating new polypeptides in a cell. This increased or decreased expression can be traced by determining the amount of cellulase, e.g., endoglucanase, cellobiohydrolase, beta-glucosidase, xylanase, mannanse, β-xylosidase, arabinofuranosidase, and/or oligomerase enzyme present or by cellulase, e.g., endoglucanase, cellobiohydrolase, beta-glucosidase, xylanase, mannanse, β-xylosidase, arabinofuranosidase, and/or oligomerase enzyme activity assays. Polypeptides, peptides and amino acids also can be detected and quantified by any method known in the art, including, e.g., nuclear magnetic resonance (Ne), spectrophotometry, radiography (protein radiolabeling), electrophoresis, capillary electrophoresis, high performance liquid chromatography (HPLC), thin layer chromatography (TLC), hyperdiffusion chromatography, various immunological methods, e.g. immunoprecipitation, immunodiffusion, immuno-electrophoresis, radioimmunoassays (RIAs), enzyme-linked immunosorbent assays (ELISAs), immuno-fluorescent assays, gel electrophoresis (e.g., SDS-PAGE), staining with antibodies, fluorescent activated cell sorter (FACS), pyrolysis mass spectrometry, Fourier-Transform Infrared Spectrometry, Raman spectrometry, GC-MS, and LC-Electrospray and cap-LC-tandem-electrospray mass spectrometries, and the like. Novel bioactivities can also be screened using methods, or variations thereof, described in U.S. Pat. No. 6,057,103. Furthermore, as discussed below in detail, one or more, or, all the polypeptides of a cell can be measured using a protein array.

Industrial, Energy, Pharmaceutical and Other Applications

Polypeptides of the invention (e.g., having cellulase, e.g., endoglucanase, cellobiohydrolase, beta-glucosidase, xylanase, mannanse, β-xylosidase, arabinofuranosidase, and/or oligomerase) can catalyze the breakdown of cellulose. The enzymes of the invention can be highly selective catalysts. The invention provides industrial processes using enzymes of the invention, e.g., in the pharmaceutical or nutrient (diet) supplement industry, the energy industry (e.g., to make "clean" biofuels), in the food and feed industries, e.g., in methods for making food and feed products and food and feed additives. In one aspect, the invention provides processes using enzymes of the invention in the medical industry, e.g., to make pharmaceuticals or dietary aids or supplements, or food supplements and additives. In addition, the invention provides methods for using the enzymes of the invention in bioethanol, including "clean" fuel, production.

The enzymes of the invention can catalyze reactions with exquisite stereo-, regio- and chemo-selectivities. The cellulase, e.g., endoglucanase, cellobiohydrolase, beta-glucosidase, xylanase, mannanse, β-xylosidase, arabinofuranosidase, and/or oligomerase enzymes of the invention can be engineered to function in various solvents, operate at extreme pHs (for example, high pHs and low pHs) extreme temperatures (for example, high temperatures and low temperatures), extreme salinity levels (for example, high salinity and low salinity) and catalyze reactions with compounds that are structurally unrelated to their natural, physiological substrates.

Biomass Conversion and Production of Clean Bio Fuels

The invention provides enzymes (including mixtures, or "cocktails" of enzymes) and methods for the conversion of a biomass or any lignocellulosic material (e.g., any composition comprising cellulose, hemicellulose and lignin), to fuels (e.g., bioethanol), in addition to feeds, foods and chemicals. Thus, the compositions and methods of the invention provide effective and sustainable alternatives or adjuncts to use of petroleum-based products, e.g., as a mixture of bioethanol and gasoline. The invention provides organisms expressing enzymes of the invention for participation in chemical cycles involving natural biomass conversion. In one aspect, enzymes and methods for the conversion are used in enzyme ensembles (or "cocktails") for the efficient depolymerization of cellulosic and hemicellulosic polymers to metabolizeable carbon moieties. Exemplary enzyme cocktails are described herein; however, the invention encompasses compositions comprising mixtures of enzymes comprising at least one (any combination of) enzyme(s) of the invention. As discussed above, the invention provides methods for discovering and implementing the most effective of enzymes to enable these important new "biomass conversion" and alternative energy industrial processes.

In one aspect, the polypeptides having cellulolytic activity, e.g., cellulases activity, such as endoglucanase, cellobiohydrolase and/or β-glucosidase (beta-glucosidase) activity, are used in processes for converting lignocellulosic biomass to ethanol. The invention also provides processes for making ethanol ("bioethanol") from compositions comprising lignocellulosic biomass. The lignocellulose biomass material can be obtained from agricultural crops, as a byproduct of food or feed production, or as lignocellulosic waste products, such as plant residues and waste paper. Examples of suitable plant residues for treatment with polypeptides of the invention include grains, seeds, stems, leaves, hulls, husks, corn cobs, corn stover, straw, grasses (e.g., Indian grass, such as *Sorghastrum nutans*; or, switch grass, e.g., *Panicum* species, such as *Panicum virgatum*), and the like, as well as wood, wood chips, wood pulp, and sawdust. Examples of paper waste suitable for treatment with polypeptides of the invention include discard photocopy paper, computer printer paper, notebook paper, notepad paper, typewriter paper, and the like, as well as newspapers, magazines, cardboard, and paper-based packaging materials.

In one aspect, the enzymes and methods of the invention can be used in conjunction with more "traditional" means of making ethanol from biomass, e.g., as methods comprising hydrolyzing lignocellulosic materials by subjecting dried lignocellulosic material in a reactor to a catalyst comprised of a dilute solution of a strong acid and a metal salt; this can lower the activation energy, or the temperature, of cellulose hydrolysis to obtain higher sugar yields; see, e.g., U.S. Pat. Nos. 6,660,506; 6,423,145.

Another exemplary method that incorporated use of enzymes of the invention comprises hydrolyzing lignocellulosic material containing hemicellulose, cellulose and lignin by subjecting the material to a first stage hydrolysis step in an aqueous medium at a temperature and a pressure chosen to effect primarily depolymerization of hemicellulose without major depolymerization of cellulose to glucose. This step results in a slurry in which the liquid aqueous phase contains dissolved monosaccharides resulting from depolymerization of hemicellulose and a solid phase containing cellulose and lignin. A second stage hydrolysis step can comprise conditions such that at least a major portion of the cellulose is depolymerized, such step resulting in a liquid aqueous phase containing dissolved/soluble depolymerization products of cellulose. See, e.g., U.S. Pat. No. 5,536,325. Enzymes of the invention can be added at any stage of this exemplary process.

Another exemplary method that incorporated use of enzymes of the invention comprises processing a lignocellulose-containing biomass material by one or more stages of dilute acid hydrolysis with about 0.4% to 2% strong acid; and treating an unreacted solid lignocellulosic component of the acid hydrolyzed biomass material by alkaline delignification to produce precursors for biodegradable thermoplastics and derivatives. See, e.g., U.S. Pat. No. 6,409,841. Enzymes of the invention can be added at any stage of this exemplary process.

Another exemplary method that incorporated use of enzymes of the invention comprises prehydrolyzing lignocellulosic material in a prehydrolysis reactor; adding an acidic liquid to the solid lignocellulosic material to make a mixture; heating the mixture to reaction temperature; maintaining reaction temperature for time sufficient to fractionate the lignocellulosic material into a solubilized portion containing at least about 20% of the lignin from the lignocellulosic material and a solid fraction containing cellulose; removing a solubilized portion from the solid fraction while at or near reaction temperature wherein the cellulose in the solid fraction is rendered more amenable to enzymatic digestion; and recovering a solubilized portion. See, e.g., U.S. Pat. No. 5,705,369. Enzymes of the invention can be added at any stage of this exemplary process.

The invention provides methods for making motor fuel compositions (e.g., for spark ignition motors) based on liquid hydrocarbons blended with a fuel grade alcohol made by using an enzyme or a method of the invention. In one aspect, the fuels made by use of an enzyme of the invention comprise, e.g., coal gas liquid- or natural gas liquid-ethanol blends. In one aspect, a co-solvent is biomass-derived 2-methyltetrahydrofuran (MTHF). See, e.g., U.S. Pat. No. 6,712,866.

Methods of the invention for the enzymatic degradation of lignocellulose, e.g., for production of ethanol from lignocellulosic material, can also comprise use of ultrasonic treatment of the biomass material; see, e.g., U.S. Pat. No. 6,333,181.

Another exemplary process for making a biofuel comprising ethanol using enzymes of the invention comprises pretreating a starting material comprising a lignocellulosic feedstock comprising at least hemicellulose and cellulose. In one aspect, the starting material comprises potatoes, soybean (rapeseed), barley, rye, corn, oats, wheat, beets or sugar cane or a component or waste or food or feed production byproduct. The starting material ("feedstock") is reacted at conditions which disrupt the plant's fiber structure to effect at least a partial hydrolysis of the hemicellulose and cellulose. Disruptive conditions can comprise, e.g., subjecting the starting material to an average temperature of 180° C. to 270° C. at pH 0.5 to 2.5 for a period of about 5 seconds to 60 minutes; or, temperature of 220° C. to 270° C., at pH 0.5 to 2.5 for a period of 5 seconds to 120 seconds, or equivalent. This generates a feedstock with increased accessibility to being digested by an enzyme, e.g., a cellulase enzyme of the invention. U.S. Pat. No. 6,090,595.

Exemplary conditions for cellulase hydrolysis of lignocellulosic material include reactions at temperatures between about 30° C. and 48° C., and/or a pH between about 4.0 and 6.0. Other exemplary conditions include a temperature between about 30° C. and 60° C. and a pH between about 4.0 and 8.0.

Animal Feeds and Food or Feed Additives

In addition to providing dietary aids or supplements, or food supplements and additives for human use, the invention also provides compositions and methods for treating animal feeds and foods and food or feed additives using a polypeptide of the invention, e.g., a protein having a cellulolytic activity, such as a cellulase activity, e.g., endoglucanase, cellobiohydrolase, beta-glucosidase, xylanase, mannanse, β-xylosidase, arabinofuranosidase, and/or oligomerase enzymes of the invention, and/or the antibodies of the invention. The invention provides animal feeds, foods, and additives comprising cellulase, e.g., endoglucanase, cellobiohydrolase, beta-glucosidase, xylanase, mannanse, β-xylosidase, arabinofuranosidase, and/or oligomerase enzymes of the invention and/or antibodies of the invention. The animal can be any farm animal or any animal.

The animal feed additive of the invention may be a granulated enzyme product that may readily be mixed with feed components. Alternatively, feed additives of the invention can form a component of a pre-mix. The granulated enzyme product of the invention may be coated or uncoated. The particle size of the enzyme granulates can be compatible with that of feed and pre-mix components. This provides a safe and convenient mean of incorporating enzymes into feeds. Alternatively, the animal feed additive of the invention may be a stabilized liquid composition. This may be an aqueous or oil-based slurry. See, e.g., U.S. Pat. No. 6,245,546.

Cellulase, e.g., endoglucanase, cellobiohydrolase, beta-glucosidase, xylanase, mannanse, β-xylosidase, arabinofuranosidase, and/or oligomerase enzymes of the present invention, in the modification of animal feed or a food, can process the food or feed either in vitro (by modifying components of the feed or food) or in vivo. Polypeptides of the invention can be added to animal feed or food compositions.

In one aspect, an enzyme of the invention is added in combination with another enzyme, e.g., beta-galactosidases, catalases, laccases, other cellulases, endoglycosidases, endo-beta-1,4-laccases, amyloglucosidases, other glucosidases, glucose isomerases, glycosyltransferases, lipases, phospholipases, lipooxygenases, beta-laccases, endo-beta-1,3(4)-laccases, cutinases, peroxidases, amylases, glucoamylases, pectinases, reductases, oxidases, decarboxylases, pbenoloxidases, ligninases, pullulanases, arabinanases, hemicellulases, mannanases, xylolaccases, xylanases, pectin acetyl esterases, rhamnogalacturonan acetyl esterases, proteases, peptidases, proteinases, polygalacturonases, rhamnogalacturonases, galactanases, pectin lyases, transglutaminases, pectin methylesterases, other cellobiohydrolases and/or transglutaminases. These enzyme digestion products are more digestible by the animal. Thus, cellulase, e.g., endoglucanase, cellobiohydrolase, beta-glucosidase, xylanase, mannanse, β-xylosidase, arabinofuranosidase, and/or oligomerase enzymes of the invention can contribute to the available energy of the feed or food, or to the digestibility of the food or feed by breaking down cellulose.

In another aspect, cellulase, e.g., endoglucanase, cellobiohydrolase, beta-glucosidase, xylanase, mannanse, β-xylosidase, arabinofuranosidase, and/or oligomerase enzyme of the invention can be supplied by expressing the enzymes directly in transgenic feed crops (as, e.g., transgenic plants, seeds and the like), such as grains, cereals, corn, soy bean, rape seed, lupin and the like. As discussed above, the invention provides transgenic plants, plant parts and plant cells comprising a nucleic acid sequence encoding a polypeptide of the invention. In one aspect, the nucleic acid is expressed such that the cellulase, e.g., endoglucanase, cellobiohydrolase, beta-glucosidase, xylanase, mannanse, β-xylosidase, arabinofuranosidase, and/or oligomerase enzyme of the invention is produced in recoverable quantities. The cellulase, e.g., endoglucanase, cellobiohydrolase, beta-glucosidase, xylanase, mannanse, β-xylosidase, arabinofuranosidase, and/or oligomerase enzyme can be recovered from any plant or plant part. Alternatively, the plant or plant part containing the recombinant polypeptide can be used as such for improving the quality of a food or feed, e.g., improving nutritional value, palatability, etc.

In one aspect, the enzyme delivery matrix of the invention is in the form of discrete plural particles, pellets or granules. By "granules" is meant particles that are compressed or compacted, such as by a pelletizing, extrusion, or similar compacting to remove water from the matrix. Such compression or compacting of the particles also promotes intraparticle cohesion of the particles. For example, the granules can be prepared by pelletizing the grain-based substrate in a pellet mill. The pellets prepared thereby are ground or crumbled to a granule size suitable for use as an adjuvant in animal feed.

Since the matrix is itself approved for use in animal feed, it can be used as a diluent for delivery of enzymes in animal feed.

In one aspect, the cellulase, e.g., endoglucanase, cellobiohydrolase, beta-glucosidase, xylanase, mannanse, β-xylosidase, arabinofuranosidase, and/or oligomerase enzyme contained in the invention enzyme delivery matrix and methods is a thermostable cellulase, e.g., endoglucanase, cellobiohydrolase, beta-glucosidase, xylanase, mannanse, β-xylosidase, arabinofuranosidase, and/or oligomerase enzyme, as described herein, so as to resist inactivation of the cellulase, e.g., endoglucanase, cellobiohydrolase, beta-glucosidase, xylanase, mannanse, β-xylosidase, arabinofuranosidase, and/or oligomerase enzyme during manufacture where elevated temperatures and/or steam may be employed to prepare the palletized enzyme delivery matrix. During digestion of feed containing the invention enzyme delivery matrix, aqueous digestive fluids will cause release of the active enzyme. Other types of thermostable enzymes and nutritional supplements that are thermostable can also be incorporated in the delivery matrix for release under any type of aqueous conditions.

In one aspect, a coating is applied to the enzyme matrix particles for many different purposes, such as to add a flavor or nutrition supplement to animal feed, to delay release of animal feed supplements and enzymes in gastric conditions, and the like. In one aspect, the coating is applied to achieve a functional goal, for example, whenever it is desirable to slow release of the enzyme from the matrix particles or to control the conditions under which the enzyme will be released. The composition of the coating material can be such that it is selectively broken down by an agent to which it is susceptible (such as heat, acid or base, enzymes or other chemicals). Alternatively, two or more coatings susceptible to different such breakdown agents may be consecutively applied to the matrix particles.

The invention is also directed towards a process for preparing an enzyme-releasing matrix. In accordance with the invention, the process comprises providing discrete plural particles of a grain-based substrate in a particle size suitable for use as an enzyme-releasing matrix, wherein the particles comprise a cellulase, e.g., endoglucanase, cellobiohydrolase, beta-glucosidase, xylanase, mannanse, β-xylosidase, arabinofuranosidase, and/or oligomerase enzyme encoded by an amino acid sequence of the invention. In one aspect, the process includes compacting or compressing the particles of enzyme-releasing matrix into granules, which most in one aspect is accomplished by pelletizing. The mold inhibitor and cohesiveness agent, when used, can be added at any suitable time, and in one aspect are mixed with the grain-based substrate in the desired proportions prior to pelletizing of the grain-based substrate. Moisture content in the pellet mill feed in one aspect is in the ranges set forth above with respect to the moisture content in the finished product, and in one aspect is about 14-15%. In one aspect, moisture is added to the feedstock in the form of an aqueous preparation of the enzyme to bring the feedstock to this moisture content. The temperature in the pellet mill in one aspect is brought to about 82° C. with steam. The pellet mill may be operated under any conditions that impart sufficient work to the feedstock to provide pellets. The pelleting process itself is a cost-effective process for removing water from the enzyme-containing composition.

The compositions and methods of the invention can be practiced in conjunction with administration of prebiotics, which are high molecular weight sugars, e.g., fructo-oligosaccharides (FOS); galacto-oligosaccharides (GOS), GRAS (Generally Recognized As Safe) material. These prebiotics can be metabolized by some probiotic lactic acid bacteria (LAB). They are non-digestible by the majority of intestinal microbes.

Treating Foods and Food Processing

The invention provides foods and feeds comprising enzymes of the invention, and methods for using enzymes of the invention in processing foods and feeds. Cellulases, e.g., endoglucanase, cellobiohydrolase, beta-glucosidase, xylanase, mannanse, β-xylosidase, arabinofuranosidase, and/or oligomerase enzymes of the invention have numerous applications in food processing industry. The invention provides methods for hydrolyzing cellulose-comprising compositions, including, e.g., a plant cell, a bacterial cell, a yeast cell, an insect cell, or an animal cell, or any plant or plant part, or any food or feed, a waste product and the like.

For example, the invention provides feeds or foods comprising a cellulase, e.g., endoglucanase, cellobiohydrolase, beta-glucosidase, xylanase, mannanse, β-xylosidase, arabinofuranosidase, and/or oligomerase enzyme the invention, e.g., in a feed, a liquid, e.g., a beverage (such as a fruit juice or a beer), a bread or a dough or a bread product, or a drink (e.g., a beer) or a beverage precursor (e.g., a wort).

The food treatment processes of the invention can also include the use of any combination of other enzymes such as tryptophanases or tyrosine decarboxylases, laccases, catalases, laccases, other cellulases, endoglycosidases, endo-beta-1,4-laccases, amyloglucosidases, other glucosidases, glucose isomerases, glycosyltransferases, lipases, phospholipases, lipooxygenases, beta-laccases, endo-beta-1,3(4)-laccases, cutinases, peroxidases, amylases, glucoamylases, pectinases, reductases, oxidases, decarboxylases, phenoloxidases, ligninases, pullulanases, arabinanases, hemicellulases, mannanases, xylolaccases, xylanases, pectin acetyl esterases, rhamnogalacturonan acetyl esterases, proteases, peptidases, proteinases, polygalacturonases, rhamnogalacturonases, galactanases, pectin lyases, transglutaminases, pectin methylesterases, other cellobiohydrolases and/or transglutaminases.

In one aspect, the invention provides enzymes and processes for hydrolyzing liquid (liquefied) and granular starch. Such starch can be derived from any source, e.g., beet, cane sugar, potato, corn, wheat, milo, sorghum, rye or bulgher. The invention applies to any plant starch source, e.g., a grain starch source, which is useful in liquefaction (for example, to make bioethanol), including any other grain or vegetable source known to produce starch suitable for liquefaction. The methods of the invention comprise liquefying starch (e.g., making bioethanol) from any natural material, such as rice, germinated rice, corn, barley, milo, wheat, legumes, potato, beet, cane sugar and sweet potato. The liquefying process can substantially hydrolyze the starch to produce a syrup. The temperature range of the liquefaction can be any liquefaction temperature which is known to be effective in liquefying starch. For example, the temperature of the starch can be between about 80° C. to about 115° C., between about 100° C. to about 110° C., and from about 105° C. to about 108° C. The bioethanols made using the enzymes and processes of the invention can be used as fuels or in fuels (e.g., auto fuels), e.g., as discussed below, in addition to their use in (or for making) foods and feeds, including alcoholic beverages.

Waste Treatment

The invention provides enzymes for use in waste treatment. Cellulases, e.g., endoglucanase, cellobiohydrolase, beta-glucosidase, xylanase, mannanse, β-xylosidase, arabinofuranosidase, and/or oligomerase enzymes of the invention can be used in a variety of waste treatment or related industrial applications, e.g., in waste treatment related to biomass conversion to generate fuels. For example, in one aspect, the invention provides a solid and/or liquid waste digestion process using cellulase, e.g., endoglucanase, cellobiohydrolase, beta-glucosidase, xylanase, mannanse, β-xylosidase, arabinofuranosidase, and/or oligomerase enzymes of the invention. The methods can comprise reducing the mass and volume of substantially untreated solid waste. Solid waste can be treated with an enzymatic digestive process in the presence of an enzymatic solution (including cellulase, e.g., endoglucanase, cellobiohydrolase, beta-glucosidase, xylanase, mannanse, β-xylosidase, arabinofuranosidase, and/or oligomerase enzymes of the invention) at a controlled temperature. This results in a reaction without appreciable bacterial fermentation from added microorganisms. The solid waste is converted into a liquefied waste and any residual solid waste. The resulting liquefied waste can be separated from said any residual solidified waste. See e.g., U.S. Pat. No. 5,709,796.

In one aspect, the compositions and methods of the invention are used for odor removal, odor prevention or odor reduction, e.g., in animal waste lagoons, e.g., on swine farms, in other ανιμαλ ωαστε μαναγεμεντ σψστεμσ, ορ ιν ανψινδυστριαλ ορ φοοδ προχεσσινγ απτ λιχατιον.

The enzymes and methods for the conversion of biomass (e.g., lignocellulosic materials) to fuels (e.g., bioethanol) can incorporate the treatment/recycling of municipal solid waste material, including waste obtained directly from a municipality or municipal solid waste that was previously land-filled and subsequently recovered, or sewage sludge, e.g., in the form of sewage sludge cake which contains substantial amounts of cellulosic material. Since sewage sludge cakes will normally not contain substantial amounts of recyclable materials (aluminum, glass, plastics, etc.), they can be directly treated with concentrated sulfuric acid (to reduce the heavy metal content of the cellulosic component of the waste) and processed in the ethanol production system. See, e.g., U.S. Pat. Nos. 6,267,309; 5,975,439.

Another exemplary method using enzymes of the invention for recovering organic and inorganic matter from waste material comprises sterilizing a solid organic matter and softening it by subjecting it to heat and pressure. This exemplary process may be carried out by first agitating waste material and then subjecting it to beat and pressure, which sterilizes it and softens the organic matter contained therein. In one aspect, after heating under pressure, the pressure may be suddenly released from a perforated chamber to forces the softened organic matter outwardly through perforations of the container, thus separating the organic matter from the solid inorganic matter. The softened sterilized, organic matter is then fermented in fermentation chamber, e.g., using enzymes of the invention, e.g., to form a mash. The mash may be subjected to further processing by centrifuge, distillation column and/or anaerobic digester to recover fuels such as ethanol and methane, and animal feed supplements. See, e.g., U.S. Pat. No. 6,251,643.

Enzymes of the invention can also be used in processes, e.g., pretreatments, to reduce the odor of an industrial waste, or a waste generated from an animal production facility, and the like. For example, enzymes of the invention can be used to treat an animal waste in a waste holding facility to enhance efficient degradation of large amounts of organic matter with reduced odor. The process can also include inoculation with sulfide-utilizing bacteria and organic digesting bacteria and lytic enzymes (in addition to an enzyme of the invention). See, e.g., U.S. Pat. No. 5,958,758.

Enzymes of the invention can also be used in mobile systems, e.g., batch type reactors, for bioremediation of aqueous, hazardous wastes, e.g., as described in U.S. Pat. No. 5,833,857. Batch type reactors can be large vessels having circulatory capability wherein bacteria (e.g., expressing an enzyme of the invention) are maintained in an efficient state by nutrients being feed into the reactor. Such systems can be used where effluent can be delivered to the reactor or the reactor is built into a waste water treatment system. Enzymes of the invention can also be used in treatment systems for use at small or temporary remote locations, e.g., portable, high volume, highly efficient, versatile waste water treatment systems.

The waste treatment processes of the invention can include the use of any combination of other enzymes such as other cellulase, e.g., endoglucanase, cellobiohydrolase, beta-glucosidase, xylanase, mannanse, β-xylosidase, arabinofuranosidase, and/or oligomerase enzymes, catalases, laccases, other cellulases, endoglycosidases, endo-beta-1,4-laccases, amyloglucosidases, other glucosidases, glucose isomerases, glycosyltransferases, lipases, phospholipases, lipooxygenases, beta-laccases, endo-beta-1,3(4)-laccases, cutinases, peroxidases, amylases, glucoamylases, pectinases, reductases, oxidases, decarboxylases, phenoloxidases, ligninases, pullulanases, phytases, arabinanases, hemicellulases, mannanases, xylolaccases, xylanases, pectin acetyl esterases, rhamnogalacturonan acetyl esterases, proteases, peptidases, proteinases, polygalacturonases, rhamnogalacturonases, galactanases, pectin lyases, tralisglutaminases, pectin methylesterases, other cellobiohydrolases and/or transglutaminases.

Detergent Compositions

The invention provides detergent compositions comprising one or more polypeptides of the invention (e.g., enzymes having cellulase, endoglucanase, cellobiohydrolase, beta-glucosidase, xylanase, mannanse, β-xylosidase, arabinofuranosidase, and/or oligomerase activity) and methods of making and using these compositions. The invention incorporates all methods of making and using detergent compositions, see, e.g., U.S. Pat. Nos. 6,413,928; 6,399,561; 6,365,561; 6,380,147. The detergent compositions can be a one and two part aqueous composition, a non-aqueous liquid composition, a cast solid, a granular form, a particulate form, a compressed tablet, a gel and/or a paste and a slurry form. The invention also provides methods capable of a rapid removal of gross food soils, films of food residue and other minor food compositions using these detergent compositions. Enzymes of the invention can facilitate the removal of starchy stains by means of catalytic hydrolysis of the starch polysaccharide. Enzymes of the invention can be used in dishwashing detergents in textile laundering detergents.

The actual active enzyme content depends upon the method of manufacture of a detergent composition and is not critical, assuming the detergent solution has the desired enzymatic activity. In one aspect, the amount of glucosidase present in the final solution ranges from about 0.001 mg to 0.5 mg per gram of the detergent composition. The particular enzyme chosen for use in the process and products of this invention depends upon the conditions of final utility, including the physical product form, use pH, use temperature, and soil types to be degraded or altered. The enzyme can be chosen to provide optimum activity and stability for any given set of utility conditions. In one aspect, the polypeptides of the present invention are active in the pH ranges of from about 4 to about 12 and in the temperature range of from about 20° C. to about 95° C. The detergents of the invention can comprise cationic, semi-polar nonionic or zwitterionic surfactants; or, mixtures thereof.

Enzymes of the present invention (e.g., enzymes having cellulase, endoglucanase, cellobiohydrolase, beta-glucosidase, xylanase, mannanse, β-xylosidase, arabinofuranosidase, and/or oligomerase activity) can be formulated into powdered and liquid detergents having pH between 4.0 and 12.0 at levels of about 0.01 to about 5% (preferably 0.1% to 0.5%) by weight. These detergent compositions can also include other enzymes such as known proteases, cellulases, lipases or endoglycosidases, as well as builders and stabilizers. The addition of enzymes of the invention to conventional cleaning compositions does not create any special use limitation. In other words, any temperature and pH suitable for the detergent is also suitable for the present compositions as long as the pH is within the above range, and the temperature is below the described enzyme's denaturing temperature. In addition, the polypeptides of the invention can be used in a cleaning composition without detergents, again either alone or in combination with builders and stabilizers.

The present invention provides cleaning compositions including detergent compositions for cleaning hard surfaces, detergent compositions for cleaning fabrics, dishwashing compositions, oral cleaning compositions, denture cleaning compositions, and contact lens cleaning solutions.

In one aspect, the invention provides a method for washing an object comprising contacting the object with a polypeptide of the invention under conditions sufficient for washing. A polypeptide of the invention may be included as a detergent additive. The detergent composition of the invention may, for example, be formulated as a hand or machine laundry detergent composition comprising a polypeptide of the invention. A laundry additive suitable for pre-treatment of stained fabrics can comprise a polypeptide of the invention. A fabric softener composition can comprise a polypeptide of the invention. Alternatively, a polypeptide of the invention can be formulated as a detergent composition for use in general household hard surface cleaning operations. In alternative aspects, detergent additives and detergent compositions of the invention may comprise one or more other enzymes such as a protease, a lipase, a cutinase, another glucosidase, a carbohydrase, another cellulase, a pectinase, a mannanase, an arabinase, a galactanase, a xylanase, an oxidase, e.g., a lactase, and/or a peroxidase. The properties of the enzyme(s) of the invention are chosen to be compatible with the selected detergent (i.e. pH-optimum, compatibility with other enzymatic and non-enzymatic ingredients, etc.) and the enzyme(s) is present in effective amounts. In one aspect, enzymes of the invention are used to remove malodorous materials from fabrics. Various detergent compositions and methods for making them that can be used in practicing the invention are described in, e.g., U.S. Pat. Nos. 6,333,301; 6,329,333; 6,326,341; 6,297,038; 6,309,871; 6,204,232; 6,197,070; 5,856,164.

The detergents and related processes of the invention can also include the use of any combination of other enzymes such as tryptophanases or tyrosine decarboxylases, laccases, catalases, laccases, other cellulases, endoglycosidases, endo-beta-1,4-laccases, amyloglucosidases, other glucosidases, glucose isomerases, glycosyltransferases, lipases, phospholipases, lipooxygenases, beta-laccases, endo-beta-1,3(4)-laccases, cutinases, peroxidases, amylases, glucoamylases, pectinases, reductases, oxidases, decarboxylases, phenoloxidases, ligninases, pullulanases, arabinanases, hemicellulases, mannanases, xylolaccases, xylanases, pectin acetyl esterases, rhamnogalacturonan acetyl esterases, proteases, peptidases, proteinases, polygalacturonases, rhamnogalacturonases, galactanases, pectin lyases, transglutaminases, pectin methylesterases, other cellobiohydrolases and/or transglutaminases.

Treating Fabrics and Textiles

The invention provides methods of treating fabrics and textiles using one or more polypeptides of the invention, e.g., enzymes having cellulase, endoglucanase, cellobiohydrolase, beta-glucosidase, xylanase, mannanse, β-xylosidase, arabinofuranosidase, and/or oligomerase activity. The polypeptides of the invention can be used in any fabric-treating method, which are well known in the art, see, e.g., U.S. Pat. No. 6,077,316. For example, in one aspect, the feel and appearance of a fabric is improved by a method comprising contacting the fabric with an enzyme of the invention in a solution. In one aspect, the fabric is treated with the solution under pressure.

In one aspect, the enzymes of the invention are applied during or after the weaving of textiles, or during the desizing stage, or one or more additional fabric processing steps. During the weaving of textiles, the threads are exposed to considerable mechanical strain. Prior to weaving on mechanical looms, warp yarns are often coated with sizing starch or starch derivatives in order to increase their tensile strength and to prevent breaking. The enzymes of the invention can be applied to remove these sizing starch or starch derivatives. After the textiles have been woven, a fabric can proceed to a desizing stage. This can be followed by one or more additional fabric processing steps. Desizing is the act of removing size from textiles. After weaving, the size coating must be removed before further processing the fabric in order to ensure a homogeneous and wash-proof result. The invention provides a method of desizing comprising enzymatic hydrolysis of the size by the action of an enzyme of the invention.

The enzymes of the invention (e.g., enzymes having cellulase, endoglucanase, cellobiohydrolase, beta-glucosidase, xylanase, mannanse, β-xylosidase, arabinofuranosidase, and/or oligomerase activity) can be used to desize fabrics, including cotton-containing fabrics, as detergent additives, e.g., in aqueous compositions. The invention provides methods for producing a stonewashed look on indigo-dyed denim fabric and garments. For the manufacture of clothes, the fabric can be cut and sewn into clothes or garments, which is afterwards finished. In particular, for the manufacture of denim jeans, different enzymatic finishing methods have been developed. The finishing of denim garment normally is initiated with an enzymatic desizing step, during which garments are subjected to the action of amylolytic enzymes in order to provide softness to the fabric and make the cotton more accessible to the subsequent enzymatic finishing steps. The invention provides methods of finishing denim garments (e.g., a "biostoning process"), enzymatic desizing and providing softness to fabrics using the Enzymes of the invention. The invention provides methods for quickly softening denim garments in a desizing and/or finishing process.

The invention also provides disinfectants comprising enzymes of the invention (e.g., enzymes having cellulase, endoglucanase, cellobiohydrolase, beta-glucosidase, xylanase, mannanse, β-xylosidase, arabinofuranosidase, and/or oligomerase activity).

The fabric or textile treatment processes of the invention can also include the use of any combination of other enzymes such as tryptophanases or tyrosine decarboxylases, laccases, catalases, laccases, other cellulases, endoglycosidases, endo-beta-1,4-laccases, amyloglucosidases, other glucosidases, glucose isomerases, glycosyltransferases, lipases, phospholipases, lipooxygenases, beta-laccases, endo-beta-1,3(4)-laccases, cutinases, peroxidases, amylases, glucoamylases, pectinases, reductases, oxidases, decarboxylases, phenoloxidases, ligninases, pullulanases, arabinanases, hemicellulases, mannanases, xylolaccases, xylanases, pectin acetyl esterases, rhamnogalacturonan acetyl esterases, proteases, peptidases, proteinases, polygalacturonases, rhamnogalacturonases, galactanases, pectin lyases, transglutaminases, pectin methylesterases, other cellobiohydrolases and/or transglutaminases.

Paper or Pulp Treatment

The enzymes of the invention (e.g., enzymes having cellulase, endoglucanase, cellobiohydrolase, beta-glucosidase, xylanase, mannanse, β-xylosidase, arabinofuranosidase, and/or oligomerase activity) can be in paper or pulp treatment or paper deinking. For example, in one aspect, the invention provides a paper treatment process using enzymes of the invention. In one aspect, the enzymes of the invention can be used to modify starch in the paper thereby converting it into a liquefied form. In another aspect, paper components of recycled photocopied paper during chemical and enzymatic deinking processes. In one aspect, Enzymes of the invention can be used in combination with other enzymes, including other cellulases (including other endoglucanases, cellobiohydrolases and/or beta-glucosidases). The wood, paper, paper product or pulp can be treated by the following three processes: 1) disintegration in the presence of an enzyme of the invention, 2) disintegration with a deinking chemical and an enzyme of the invention, and/or 3) disintegration after soaking with an enzyme of the invention. The recycled paper treated with an enzyme of the invention can have a higher brightness due to removal of toner particles as compared to the paper treated with just cellulase. While the invention is not limited by any particular mechanism, the effect of an enzyme of the invention may be due to its behavior as surface-active agents in pulp suspension.

The invention provides methods of treating paper and paper pulp using one or more polypeptides of the invention. The polypeptides of the invention can be used in any paper- or pulp-treating method, which are well known in the art, see, e.g., U.S. Pat. Nos. 6,241,849; 6,066,233; 5,582,681. For example, in one aspect, the invention provides a method for deinking and decolorizing a printed paper containing a dye, comprising pulping a printed paper to obtain a pulp slurry, and dislodging an ink from the pulp slurry in the presence of an enzyme of the invention (other enzymes can also be added). In another aspect, the invention provides a method for enhancing the freeness of pulp, e.g., pulp made from secondary fiber, by adding an enzymatic mixture comprising an enzyme of the invention (can also include other enzymes, e.g., pectinase enzymes) to the pulp and treating under conditions to cause a reaction to produce an enzymatically treated pulp. The freeness of the enzymatically treated pulp is increased from the initial freeness of the secondary fiber pulp without a loss in brightness.

The paper, wood or pulp treatment or recycling processes of the invention can also include the use of any combination of other enzymes such as tryptophanases or tyrosine decarboxylases, laccases, catalases, laccases, other cellulases, endoglycosidases, endo-beta-1,4-laccases, amyloglucosidases, other glucosidases, glucose isomerases, glycosyltransferases, lipases, phospholipases, lipooxygenases, beta-laccases, endo-beta-1,3(4)-laccases, cutinases, peroxidases, amylases, glucoamylases, pectinases, reductases, oxidases, decarboxylases, phenoloxidases, ligninases, pullulanases, arabinanases, hemicellulases, mannanases, xylolaccases, xylanases, pectin acetyl esterases, rhamnogalacturonan acetyl esterases, proteases, peptidases, proteinases, polygalacturonases, rhamnogalacturonases, galactanases, pectin lyases, transglutaminases, pectin methylesterases, other cellobiohydrolases and/or transglutaminases.

Repulping: Treatment of Lignocellulosic Materials

The invention also provides a method for the treatment of lignocellulosic fibers, wherein the fibers are treated with a polypeptide of the invention (e.g., enzymes having cellulase, endoglucanase, cellobiohydrolase, beta-glucosidase, xylanase, mannanse, β-xylosidase, arabinofuranosidase, and/or oligomerase activity), in an amount which is efficient for improving the fiber properties. The enzymes of the invention may also be used in the production or recycling of lignocellulosic materials such as pulp, paper and cardboard, from starch reinforced waste paper and cardboard, especially where repulping or recycling occurs at pH above 7 and where the enzymes of the invention can facilitate the disintegration of the waste material through degradation of the reinforcing starch. The enzymes of the invention can be useful in a process for producing a papermaking pulp from starch-coated printed paper. The process may be performed as described in, e.g., WO 95/14807. An exemplary process comprises disintegrating the paper to produce a pulp, treating with a starch-degrading enzyme before, during or after the disintegrating, and separating ink particles from the pulp after disintegrating and enzyme treatment. See also U.S. Pat. No. 6,309,871 and other US patents cited herein. Thus, the invention includes a method for enzymatic deinking of recycled paper pulp, wherein the polypeptide is applied in an amount which is efficient for effective de-inking of the fiber surface.

Brewing and Fermenting

The invention provides methods of brewing (e.g., fermenting) beer comprising an enzyme of the invention, e.g., enzymes having cellulase, endoglucanase, cellobiohydrolase, beta-glucosidase, xylanase, mannanse, β-xylosidase, arabinofuranosidase, and/or oligomerase activity. In one exemplary process, starch-containing raw materials are disintegrated and processed to form a malt. An enzyme of the invention is used at any point in the fermentation process. For example, enzymes of the invention can be used in the processing of barley malt. The major raw material of beer brewing is barley malt. This can be a three stage process. First, the barley grain can be steeped to increase water content, e.g., to around about 40%. Second, the grain can be germinated by incubation at 15-25° C. for 3 to 6 days when enzyme synthesis is stimulated under the control of gibberellins. During this time enzyme levels rise significantly. In one aspect, enzymes of the invention are added at this (or any other) stage of the process. The action of the enzyme results in an increase in fermentable reducing sugars. This can be expressed as the diastatic power, DP, which can rise from around 80 to 190 in 5 days at 12° C.

Enzymes of the invention can be used in any beer producing process, as described, e.g., in U.S. Pat. Nos. 5,762,991; 5,536,650; 5,405,624; 5,021,246; 4,788,066.

Increasing the Flow of Production Fluids from a Subterranean Formation

The invention also includes a method using an enzyme of the invention (e.g., enzymes having cellulase, endoglucanase, cellobiohydrolase, beta-glucosidase, xylanase, mannanse, β-xylosidase, arabinofuranosidase, and/or oligomerase activity), wherein the method increases the flow of production fluids from a subterranean formation by removing viscous, starch-containing, damaging fluids formed during production operations; these fluids can be found within the subterranean formation which surrounds a completed well bore. Thus, this method of the invention results in production fluids being able to flow from the well bore. This method of the invention also addresses the problem of damaging fluids reducing the flow of production fluids from a formation below expected flow rates. In one aspect, the invention provides for formulating an enzyme treatment (using an enzyme of the invention) by blending together an aqueous fluid and a polypeptide of the invention; pumping the enzyme treatment to a desired location within the well bore; allowing the enzyme treatment to degrade the viscous, starch-containing, damaging fluid, whereby the fluid can be removed from the subterranean formation to the well surface; and wherein the enzyme treatment is effective to attack the alpha glucosidic linkages in the starch-containing fluid.

The subterranean formation enzyme treatment processes of the invention can also include the use of any combination of other enzymes such as tryptophanases or tyrosine decarboxylases, laccases, catalases, laccases, other cellulases, endoglycosidases, endo-beta-1,4-laccases, amyloglucosidases, other glucosidases, glucose isomerases, glycosyltransferases, lipases, phospholipases, lipooxygenases, beta-laccases, endo-beta-1,3(4)-laccases, cutinases, peroxidases, amylases, glucoamylases, pectinases, reductases, oxidases, decarboxylases, phenoloxidases, ligninases, pullulanases, arabinanases, hemicellulases, mannanases, xylolaccases, xylanases, pectin acetyl esterases, rhamnogalacturonan acetyl esterases, proteases, peptidases, proteinases, polygalacturonases, rhamnogalacturonases, galactanases, pectin lyases, transglutaminases, pectin methylesterases, other cellobiohydrolases and/or transglutaminases.

Pharmaceutical Compositions and Dietary Supplements

The invention also provides pharmaceutical compositions and dietary supplements (e.g., dietary aids) comprising a cellulase of the invention (e.g., enzymes having endoglucanase, cellobiohydrolase, beta-glucosidase, xylanase, mannanse, β-xylosidase, arabinofuranosidase, and/or oligomerase activity). The cellulase activity comprises endoglucanase, cellobiohydrolase, beta-glucosidase, xylanase, mannanse, β-xylosidase, arabinofuranosidase, and/or oligomerase activity. In one aspect, the pharmaceutical compositions and dietary supplements (e.g., dietary aids) are formulated for oral ingestion, e.g., to improve the digestibility of foods and feeds having a high cellulose or lignocellulosic component.

Periodontal treatment compounds can comprise an enzyme of the invention, e.g., as described in U.S. Pat. No. 6,776,979. Compositions and methods for the treatment or prophylaxis of acidic gut syndrome can comprise an enzyme of the invention, e.g., as described in U.S. Pat. No. 6,468,964.

In another aspect, wound dressings, implants and the like comprise antimicrobial (e.g., antibiotic-acting) enzymes, including an enzyme of the invention (including, e.g., exemplary sequences of the invention). Enzymes of the invention can also be used in alginate dressings, antimicrobial barrier dressings, burn dressings, compression bandages, diagnostic tools, gel dressings, hydro-selective dressings, hydrocellular (foam) dressings, hydrocolloid dressings, I.V dressings, incise drapes, low adherent dressings, odor absorbing dressings, paste bandages, post operative dressings, scar management, skin care, transparent film dressings and/or wound closure. Enzymes of the invention can be used in wound cleansing, wound bed preparation, to treat pressure ulcers, leg ulcers, burns, diabetic foot ulcers, scars, IV fixation, surgical wounds and minor wounds. Enzymes of the invention can be used to in sterile enzymatic debriding compositions, e.g., ointments. In various aspects, the cellulase is formulated as a tablet, gel, pill, implant, liquid, spray, powder, food, feed pellet or as an encapsulated formulation.

Biodefense Applications

In other aspects, cellulases of the invention (e.g., enzymes having endoglucanase, cellobiohydrolase, beta-glucosidase, xylanase, mannanse, β-xylosidase, arabinofuranosidase, and/or oligomerase activity) can be used in biodefense (e.g., destruction of spores or bacteria comprising a lignocellulosic material). Use of cellulases of the invention in biodefense applications offer a significant benefit, in that they can be very rapidly developed against any currently unknown or biological warfare agents of the future. In addition, cellulases of the invention can be used for decontamination of affected environments. In aspect, the invention provides a biodefense or bio-detoxifying agent comprising a polypeptide having a cellulase activity, wherein the polypeptide comprises a sequence of the invention (including, e.g., exemplary sequences of the invention), or a polypeptide encoded by a nucleic acid of the invention (including, e.g., exemplary sequences of the invention), wherein optionally the polypeptide has activity comprising endoglucanase, cellobiohydrolase, beta-glucosidase, xylanase, mannanse, β-xylosidase, arabinofuranosidase, and/or oligomerase activity.

The following examples are offered to illustrate, but not to limit the claimed invention.

EXAMPLES

Example 1

GIGAMATRIX™ Screen

In one aspect, the methods of the invention use Diversa Corporation's proprietary GIGAMATRIX™ platform; see PCT Patent Publication No. WO 01/38583; U.S. patent application no. 20050046833; 20020080350; U.S. Pat. No. 6,918,738; Design Pat. No. D480,814. For example, in one aspect, GIGAMATRIX™ is used in methods to determine if a polypeptide has cellulase activity and is within the scope of the invention, or, to identify and isolate a polypeptide having cellulolytic activity, e.g., cellulase activity, such as endoglucanase, cellobiohydrolase and/or β-glucosidase (beta-glucosidase) activity.

A GIGAMATRIX™ platform can include an ultra-high throughput screen based on a 100,000 well microplate with the dimensions of a conventional 96 well plate. In this example, the GIGAMATAIX™ screen can be implemented using 2 substrates—Methylumbelliferyl cellobioside (MUC) and methylumbelliferyl lactoside (MUL). Phagemid versions of different clones can be screened because the substrate diffuses into cells and fluorescence was thought to be more easily detectable. A host strain lacking, beta-galactosidase can be used in order to decrease activity on the lactoside substrate. The lactoside substrate can result in fewer hits and can be deemed more specific than the cellobiose substrate. In addition, the lactoside substrate can result in fewer beta-glucosidase hits. A secondary screening can consist of plating the clones on agar plates and then colony picking into 384 well plates containing media and MUL. Active clones against MUL are differentiated from a background of inactive clones. Individual clones can then be grown to overnight and fluorescence measured. The most active hits can then be picked for sequencing.

Characterization Enzyme and Substrate Activity

The hits discovered in the GIGAMATRIX™ screen can first be screened against cellohexaose to determine action pattern on a cellulose oligomer. Clones can be grown overnight in TB media containing antibiotic, cells can then be lysed and lysates clarified by centrifugation. Subclones can be grown to an $OD600=0.5$ induced with an appropriate inducer and then grown an additional 3 h before lysing the cells and clarifying the lysate. Genomic clones will generally have less activity than a subclone, but are a more facile way of assessing activity in a large range of clones. Initial studies can be performed using thin layer chromatography (TLC) for endpoint reactions usually run for 24 h. Enzymes can also be tested on phosphoric acid swollen cellulose (PASC), which is crystalline cellulose that is made more amorphous through swelling by acid treatment.

Cellulases which are active against PASC, can also release cellobiose as well as celltriose and/or glucose. The clones from the GIGAMATRIX™ discovery effort can be also tested against PASC and on cellulosic substrates such as cellohexaose (Seikagaku, Japan). Thin layer chromatography (TLC) experiments can be use to show that clones are able to hydrolyze the cellohexaose. Of these clones, some are able to generate glucose as the final product. Several enzymes can produce cellobiose and/or larger fragments, but when the exact nature of the product pattern can not be discerned from the TLC experiments, a capillary electrophoresis (CE) method can also be used.

Example 2

Capillary Electrophoresis

In some aspects, Capillary Electrophoresis (CE) is used in assays to screen for enzyme activity, e.g., CE is used in methods to determine if a polypeptide has cellulolytic activity, e.g., cellulases activity, such as endoglucanase, cellobiohydrolase and/or β-glucosidase (beta-glucosidase) activity, and is within the scope of the invention, or, to identify and isolate a polypeptide having cellulolytic activity, e.g., cellulase activity. Capillary Electrophoresis (CE) offers the advantages of faster run times and greater assay sensitivity. The CE method can use 1-aminopyrene-3,6,8-trisulfonate (APTS) as the fluorophore and can be optimized for use with sugars and sugar oligomers (Guttman (1996) High-resolution capillary gel electrophoresis of reducing oligosaccharides labeled with 1-aminopyrene-3,6,8-trisulfonate. Anal. Biochem 233:234-242). Enzymes that are active on cellohexaose can be subjected to tests on phosphoric acid swollen cellulose as well as cellohexaose. Genes can be subcloned, expressed and partially purified using a nickel-chelating column. Enzymes can be incubated with substrate for 1 h and the products analyzed using a 10 cm or 48 cm capillary. Cellohexaose elutes at 2 and 9 minutes for the 10 and 48 cm capillaries respectively. The 48 cm capillary gives better separation of products in case there are low amounts of sugar or if there are contaminants in the mixture. The CE method can be implemented for studies on enzymes from the GIGAMATRIX™ discovery that show good activity on cellohexaose with TLC detection.

Glycosyl hydrolase family 5 contains mainly endoglucanases, but there are examples of cellobiohydrolases. CelO from *Clostridium thermocellum* has been characterized as a cellobiohydrolase based on activity on release of only cellobiose from amorphic and crystalline cellulose (Zverlov (2002) A newly described cellulosomal cellobiohydrolase, CelO, from *Clostridium thermocellum*: investigation of the exo-mode of hydrolysis, and binding capacity to crystalline cellulose. Microbiology 148:247-255).

The endoglucanase from *Acidothermus cellulolyticus* has an insertion that is in close proximity to the substrate binding site. This insertion could form a loop which encloses the substrate binding site thus converting this enzyme from an endoglucanase to a cellobiohydrolase. When enzymes tested on cellohexaose produce mainly cellobiose with a smaller amount of cellotriose, this can be explained by the fact that cellobiohydrolases have the capability to produce both cellobiose and cellotriose from a cellohexaose substrate (Harjunpaa (1996) Cello-oligosaccharide hydrolysis by cellobiohydrolase II from *Trichoderma reesei*. Association and rate constants derived from an analysis of progress curves. Eur. J. Biochem 240:584-591).

Example 3

Sequence Based Discovery

The invention provides methods for identifying and isolating cellulases, e.g., cellobiohydrolases, using sequences of the invention. In one exemplary method, primers that are homologous to conserved regions of three glycosyl hydrolase families that contain cellobiohydrolases can be used to screen either polynucleotide libraries or DNA derived from fungal samples. For example, primers can be designed towards family 48 conserved regions and towards family 6 and family 7. Fungal libraries can be screened with these primers.

Example 4

Genetic Engineering of an Enzyme with Cellobiohydrolase Activity

This example describes the genetic engineering of an exemplary enzyme of the invention. This enzyme can be used in the conversion of biomass to fuels and chemicals, and for making effective and sustainable alternatives to petroleum-based products. This enzyme can be expressed in organisms (e.g., microorganisms, such as bacteria) for its participation in chemical cycles involving natural biomass conversion. In one aspect, this enzyme is used in "enzyme ensembles" for the efficient depolymerization of cellulosic and hemicellulosic polymers to metabolizable carbon moieties. As discussed above, the invention provides methods for discovering and implementing the most effective of enzymes to enable these important new "biomass conversion" and alternative energy industrial processes.

Using metagenomic discovery and a non-stochastic method of directed evolution (called "DIRECTEVOLUTION®, as described, e.g., in U.S. Pat. No. 6,939,689, which includes Gene Site Saturation Mutagenesis (GSSM) (as discussed above, see also U.S. Pat. Nos. 6,171,820 and 6,579, 258) and Tunable GeneReassembly (TGR) (see, e.g., U.S. Pat. No. 6,537,776) technologies. These technologies can be used for the discovery and optimization of an enzyme component for cellulose reduction to glucose, cellobiohydrolase.

An enzyme discovery screen can be implemented using Diversa Corporation's GIGAMATRIX™ high throughput expression screening platform (discussed above) to identify cellobiohydrolases using methylumbelliferyl cellobioside as substrate. Hits can be characterized for activity against AVICEL® Microcrystalline Cellulose (MCC) (FMC Corporation, Philadelphia, Pa.). An enzyme can be chosen as a candidate for optimization using Gene Site Saturation Mutagenesis (GSSM) technology. However, before performing GSSM evolution, the signal sequence, if present, can be removed and a starting methionine added. As discussed above, GSSM technology can rapidly mutate all amino acids in the protein to the 19 other amino acids in a sequential fashion. Mutants can be screened using a fiber-based assay and potential upmutants representing single amino acid changes can be identified. These upmutants can be combined into a new library representing combinations of the upmutants. This library can be screened resulting in identification of several candidate enzymes for commercialization.

Research Summary
GIGAMATRIX™ Screen

The GIGAMATRIX™ (GMx) screening platform is an ultra-high throughput method based on a 100,000 well microplate with the dimensions of a conventional 96 well plate (see Phase II application for details). The screen works with fluorescent substrates. The GMx screen can be implemented using 2 substrates based on previously shown activity by cellulases. Methylumbelliferyl cellobioside (MUC) can be used as the screening substrate. In addition, resorufin-beta-glucopyranoside can be also included in the screen in order to eliminate clones that have activity on both substrates and are presumed to be beta-glucosidases.

Amplified phage or phagemid versions of the target libraries can be screened. Host strains lacking beta-galactosidase genes can be used in order to decrease endogenous host activity on the substrates. Libraries can be chosen for screening based on the fact that these libraries yielded cellulase hits from a previous screening program.

Figure 10:
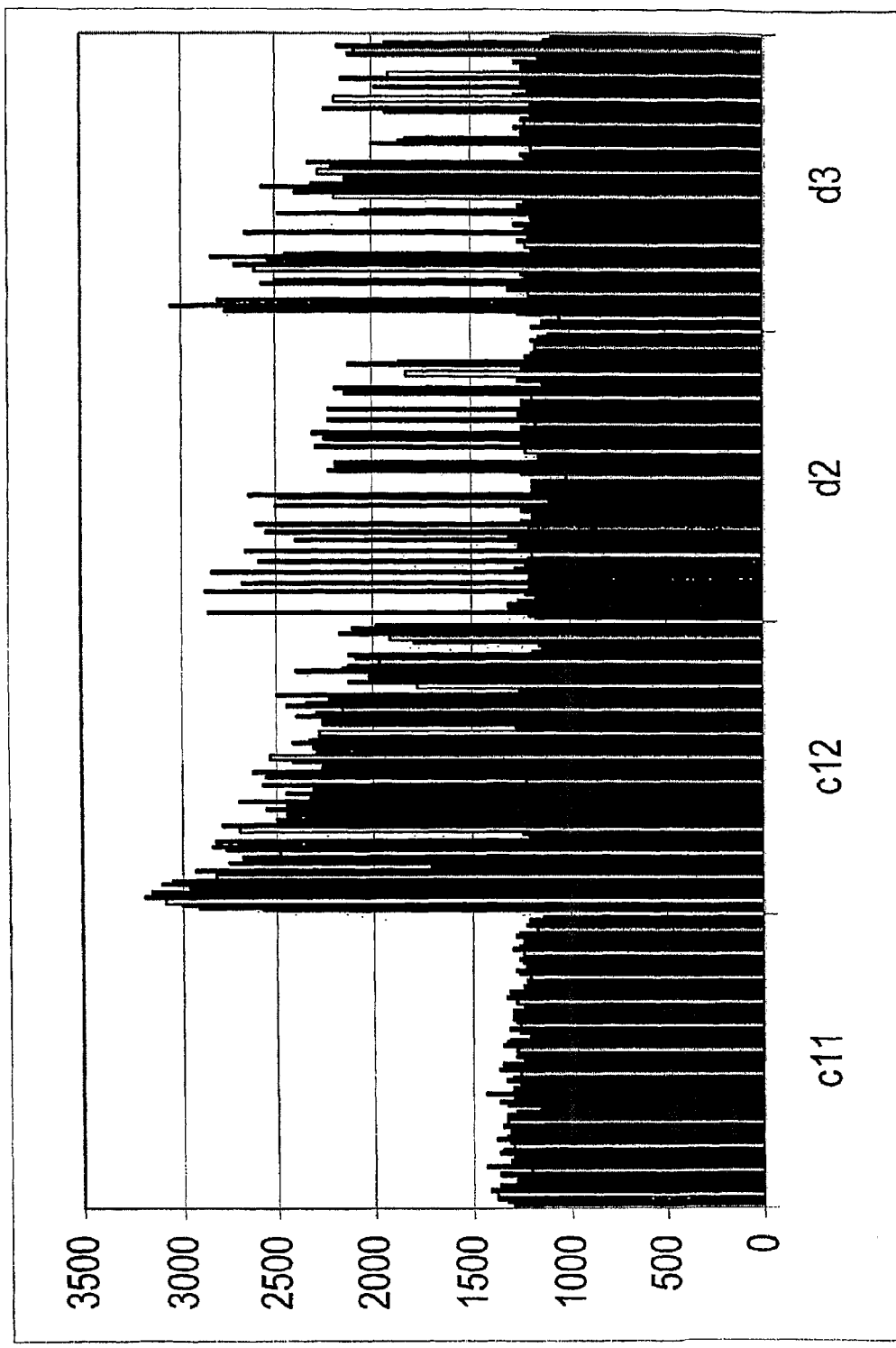
FIG. 10 illustrates in graphic form data showing a typical GIGAMATRIX™ breakout, where active clones expressing enzyme able to hydrolyze methylumbelliferyl cellobioside are identified, as discussed in detail in Example 4, below.

Secondary screening can consist of plating the clones on agar plates and then colony picking into 384 well plates containing media and methylumbelliferyl cellobioside (MUC) termed a "breakout". FIG. 10 illustrates in graphic form data showing a typical GIGAMATRIX™ (GMx) breakout. To generate this data, active clones against MUC (i.e., able to hydrolyze methylumbelliferyl cellobioside) are differentiated from a background of inactive clones. Individual clones were then grown overnight and fluorescence was measured and the most active hits were picked for sequencing. In FIG. 10, the X axis shows sample name; Y axis is relative fluorescent units. Positive "hits" were plated onto agar plates and then colony picked into 384 well plates containing LB+antibiotic plus 50 µM MUGC and grown overnight.

Characterization

Genes discovered in the GIGAMATRIX™ screen can be sequenced and the data analyzed. Open reading frames (ORFs) can be annotated using a software system. The ORFs can be subcloned into the appropriate vector(s) with the introduction of DNA encoding C-terminal His-tags. Construct DNA can be transformed into the appropriate $E.\ coli$ host(s) and expressed for characterization studies. The gene products can be screened against phosphoric acid-swollen cellulose (PASC). PASC is crystalline cellulose that is made more amorphous through swelling by acid treatment. PASC was prepared from AVICEL® Microcrystalline Cellulose (MCC). Subclones can be grown, expressed and lysed. Lysates can be incubated with PASC and the reaction products analyzed using the bicinchoninic acid (BCA) reducing sugar assay. The most active subclones can be selected for larger scale growth and purification. The specific activity of these subclones can be determined on PASC.

The subclones can be also analyzed by capillary electrophoresis (CE). Lysates can be incubated with substrate for 30 hours. The reaction products can be derivatized with the fluorophore 1-aminopyrene-3,6,8-trisulfonate (APTS). The products can be analyzed using a 48 cm capillary. Cellobiose elutes at 6 minutes. The results can show that several enzymes have reaction product profiles representative of processive enzymes. A processive enzyme is defined as having a ratio of cellobiose/(glucose+cellotriose) 10.

Fungal CBHs in *Pichia*

Genes of newly discovered cellobiohydrolases can be transformed into *P. pastoris* and the transformations can be spread onto solid agar plates. The samples can be grown and induced and the supernatants incubated with PASC in the presence of a β-glucosidase. The reaction products can be analyzed using the glucose-oxidase assay. A glycosyl hydrolase family 6 cellobiohydrolase, was successfully heterologously expressed in *P. pastoris*.

GSSM Screening

GSSM technology (discussed above) was used to rapidly and sequentially mutate the amino acids of the catalytic and carbohydrate binding domain of the target protein into the 19 other amino acids. In addition, variants of a wild-type enzyme can be tested to determine the effects of the domains on activity. For example, the wild-type enzyme can be was subcloned with: 1) the catalytic domain alone (CD); 2) the catalytic and carbohydrate domain (CCD); and 3) the catalytic and carbohydrate binding domain plus downstream amino acids (CCD+D S). The full-length protein and the variants can be assayed on AVICEL® Microcrystalline Cellulose (MCC) and the reaction products analyzed by the BCA reducing sugar assay.

The goal of the GSSM screen was to identify mutants that increased the extent of hydrolysis on insoluble microcrystalline cellulose. A robotic screening method was developed to facilitate the GSSM screening process.

DNA from mutation constructs can be transformed into DH10b host cells. Individual colonies can be picked into 96 well (shallow) plates containing 150 uL LB/Ampicillin using the automatic colony picking system. The plates can be incubated for 24 hours at 37° C., 400 rpm. 15 uL of culture is then transferred from each well into an induction plate. Each well of the induction plate contained 135 uL LB/Ampicillin with 1.1 mM IPTG. The induction plates can be incubated for 24 hours at 37° C., 400 rpm. The plates can be centrifuged and the supernatant discarded.

The automated portion of the assay can be used at this point. The cells can be lysed and resuspended by the robot. 150 uL of lysis buffer (125 uL water plus 25 uL BPER containing 0.2 mg/ml lysozyme and 20 unit/ml DNase I) can be added to each well. 15 uL lysate is then transferred from each well to a reaction plate. Each well of the reaction plate can contain 185 uL of a reaction mix (1% AVICEL® Microcrystalline Cellulose (MCC), 50 mM sodium acetate buffer pH5.0). The reaction plates can be incubated at 37° C. for 30 hours with 95% humidity. After incubation, the plates can be centrifuged and 15 uL supernatant transferred to BCA plates. The BCA plates can contain 50 uL reagent A, 50 uL reagent B, and 80 uL 400 mM Carbonate buffer, pH 10 per well. The plates can be covered with rubber seals and incubated at 80° C. for 30 minutes, then cooled by centrifugation and the absorbance read at A560.

Primary hits can be reconfirmed in a secondary assay. This assay can be the same as the primary screen. Hits from the secondary screen can be further analyzed. The GSSM upmutants can be mapped onto the crystal structure of known enzymes of the same class. Samples can be prioritized based on amino acid location, amino acid change and the fold improvement score. Upmutants can then be selected from the GSSM screening and selected for gene reassembly evolution, i.e., Tunable GeneReassembly (TGR), discussed above, and also see, e.g., U.S. Pat. No. 6,537,776.

Blending of Unmutants

Using gene reassembly (Tunable GeneReassembly (TGR)) technology, GSSM upmutants can be blended in order to identify the candidate with the best activity. Activity assays can be the same as for the GSSM screening except reactions can be further diluted to account for increased activity of upmutants over the wildtype enzyme.

Example 5

Enzyme Mixtures, or "Cocktails" for Processing/Converting Biomass

This example describes the development of enzyme mixtures, or "cocktails", to digest biomass, including ammonia-pretreated biomass, into fermentable sugars. In one aspect, the enzyme mixtures, or "cocktails" comprise at least one exemplary enzyme of the invention.

The enzyme mixtures, or "cocktails", of the invention are used to hydrolyze cellulose or any β1,4-linked glucose moieties and/or hemicellulose or any branched polymer comprising a β-1,4-linked xylose backbone with branches of arabinose, galactose, mannose, glucuronic acid, and/or linkages to lignin, e.g., via ferulic acid ester groups. Thus, in various aspects, the methods and compositions of the invention address the complexity and problems of digestion of hemicellulose to monomer sugars due to the variability of sugars and linkages.

Prior attempts to develop enzymes for the biorefinery have not been successful for 2 main reasons. First, current enzyme usage rates are very high (approx. 100 g enzyme/gal ethanol) resulting in high production costs. There have been minimal efforts to improve the performance of the cellulase enzymes. In general the focus has been to reduce enzyme cost by increasing production yields in Trichoderma reesei thus improving fermentation economics. However, in order for the biorefinery to become commercial, enzyme usage rates must be dramatically lower. Second, non-commercial thermochemical pretreatment conditions were used on the corn stover feedstock therefore minimal effort has been expended on enzymatic digestion of hemicellulose. We have observed and it has been reported that effective digestion of the hemicellulose component improves the rate of cellulose digestion.

In one aspect, an enzyme mixture, or cocktail, comprising (consisting of) nine specific proteins (enzymes) has been developed to provide maximal cellulose and hemicellulose digestion of ammonia pretreated biomass, for example, in this exemplary process, for the conversion of ammonia pretreated corn cob. The cocktail contains (comprises) a minimal set of enzymes (see below) active on cellulose, i.e., an endoglucanase, a cellobiohydrolase I, a cellobiohydrolase II and a β-glucosidase; and five (5) enzymes active on hemicellulose, i.e., a xylanase GH11, a xylanase GH10, a β-xylosidase, an arabinofuranosidase GH51 and an arabinofuranosidase GH62. This cocktail was developed by screening enzyme libraries for the ability to release soluble reducing sugars individually and in concert with each other. The table below details the enzymes, their specific class and the usage in a typical hydrolysis experiment.

| Enzyme | Class | Usage (mg/g cellulose) |
|---|---|---|
| EG1_CDCBM3 | Endoglucanase | 1.7 |
| SEQ ID NO: 98 (encoded by, e.g., SEQ ID NO: 97) | Cellobiohydrolase II | 1 |
| SEQ ID NO: 34 (encoded by, e.g., SEQ ID NO: 33) | Cellobiohydrolase I | 10 |
| SEQ ID NO: 94 (encoded by, e.g., SEQ ID NO: 93) | β-glucosidase | 2.6 |
| SEQ ID NO: 100 (encoded by, e.g., SEQ ID NO: 99) | Endoxylanase GH11 | 0.6 |
| SEQ ID NO: 102 (encoded by, e.g., SEQ ID NO: 101) | Endoxylanase GH10 | 0.2 |
| SEQ ID NO: 96 (encoded by, e.g., SEQ ID NO: 95) | β-xylosidase | 0.5 |
| SEQ ID NO: 92 (encoded by, e.g., SEQ ID NO: 91) | Arabinofuranosidase | 0.3 |
| SEQ ID NO: 104 (encoded by, e.g., SEQ ID NO: 103) | Arabinofuranosidase GH62 | 2.0 |

Figure 16:
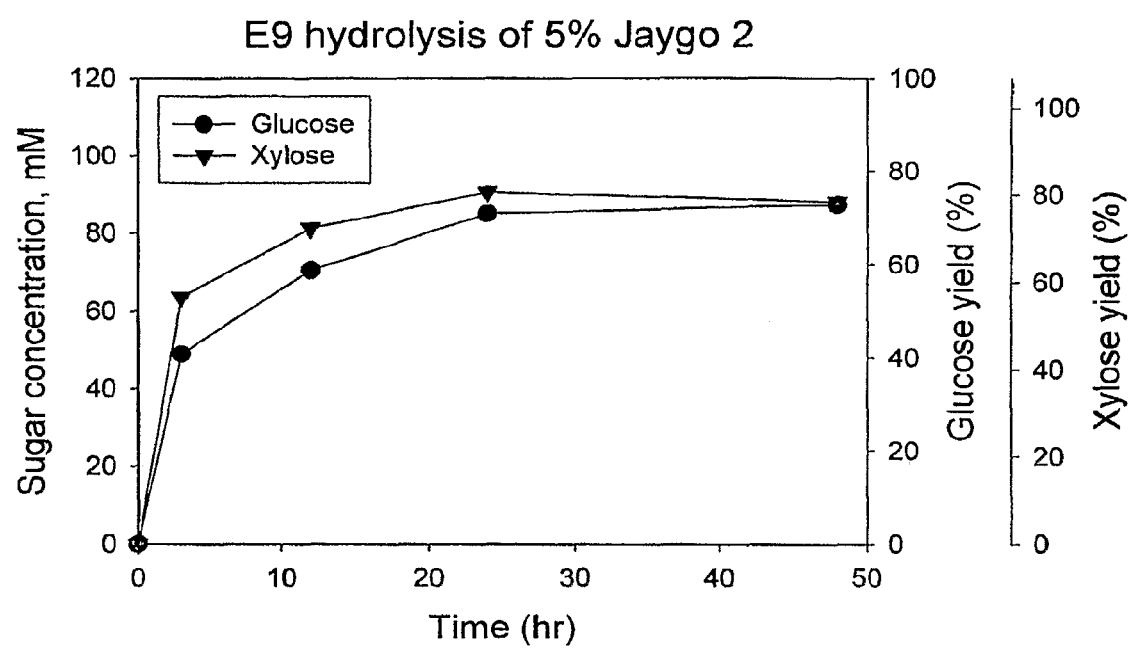
FIG. 16 illustrates in graphic form data from the enzymatic treatment of pretreated corn cob, as discussed in detail in Example 5, below.

A representative progress curve is shown in FIG. 16 using the recipe shown in the table above (e.g., at the usage amounts of enzyme in mg (enzyme)/g cellulose) at 5% solids pretreated corn cob (designated "Jaygo 2" in the figure) at pH 5.5 and 50° C.

This enzymatic mixture, or "cocktail", of hemicellulose- and cellulose-hydrolyzing enzymes can be used with or as a substitution for commercial cellulase preparations, e.g., those derived from crude fungal culture broths, such as Trichoderma reesei.

The development of the cocktails of the invention started with the discovery of an organism that was observed to grow and digest cellulosic materials. Over the past several decades classical strain development was used to optimize these strains as cellulase producers, in general this resulted in hypersecretor strains without specifically improving the enzymes themselves. These mixtures contain some redundant and unnecessary proteins, and are deficient in many enzyme activities that are required to digest alkaline pretreated biomass. In general, fungal culture broths have been optimized and/or tailored to acid-treated biomass which no longer contains polymeric hemicellulose, hence the preparations are enriched in cellulase activity while deficient in hemicellulase activity.

In contrast, in one aspect, methods of the invention use a pretreatment process based on dilute ammonia to hydrolyze ester linkages but not glycosidic linkages, thereby resulting in intact insoluble hemicellulose. These exemplary enzyme cocktails of the invention therefore comprise both cellulase and hemicellulase activities to completely release glucose, xylose and arabinose. For example, in one aspect, enzyme cocktails of the invention can digest both cellulose and the hemicellulose component of ammonia-pretreated corn cob and stover (corn stover is the residue that is left behind after corn grain harvest). Removal of the hemicellulose "sheath" surrounding the cellulose fibers by the enzyme "cocktails" of the invention will enhance cellulase activity and improve overall performance.

In one aspect, the enzyme mixtures of the invention are used in biorefineries at enzyme usage rates that are lower than the approximately 100 g enzyme/gal ethanol now used in bioethanol production processes; thus resulting in lower production costs. These compositions and enzymes of the invention can be used to reduce enzyme costs in biorefineries and improve fermentation economics.

In another aspect, the compositions and methods of the invention are used in conjunction with non-commercial thermochemical pretreatment conditions, e.g., to treat biomass such as corn stover feedstock. The incorporation of the enzymatic digestion of hemicellulose in practicing the compositions and methods of the invention makes processes using these compositions and methods particularly efficient. The effective digestion of a hemicellulose component in a biomass, e.g., a plant biomass, can improve the rate of cellulose digestion.

In developing this aspect of the invention, high throughput screens were established to survey glycosyl hydrolases for effectiveness of hydrolysis of model substrates, e.g., AVICEL® microcrystalline cellulose and alkaline pretreated corn stover. In addition, enzymes in relatively under-represented enzyme classes such as the cellobiohydrolases and β-glucosidases were investigated. Cellobiohydrolase discovery focused on sequence-based (hybridization) methods and fungal gene libraries while β-glucosidase discovery focused on activity-based methods and bacterial gene libraries. Once individual enzymes were found to be efficacious on pretreated biomass combinations of enzymes were tested for enhanced or synergistic performance. This included enzymes that hydrolyze cellulose and hemicellulose.

In developing this aspect of the invention, it was recognized that removal of the hemicellulose "sheath" surrounding cellulose had a positive effect on cellulose hydrolysis. The endo-xylanases cleaved insoluble hemicellulose into soluble oligosaccharides that effectively removed the barrier to cellulose. Additionally recalcitrant oligosaccharides were characterized to determine their composition such that enzymes with the appropriate specificity could be found which would convert the oligosaccharides into monomer sugar(s). Hence the enzyme cocktails of the invention are tailored to the feedstock and the pretreatment chemistry. A minimal set of enzymes has been designed to attack specifically the linkages present in the pretreated biomass.

In one aspect, the enzyme cocktails of the invention are specifically tailored to a pretreatment chemistry to provide an optimal solution to enzymatic digestion. In one aspect, the enzyme mixtures, or cocktails, of the invention are advantageous in that they have no redundant protein enzymes. Additionally, all cellulose linkages and sugars are addressed, in contrast to natural enzyme mixtures found in a native system which were not developed or modified to work on a non-natural substrate.

Another aspect of the invention comprises an enzyme cocktail (designated "E9") that efficiently hydrolyses cellulose and hemicellulose from biomass:

| Enzyme | Protein in cocktail (mg/ml) |
|---|---|
| SEQ ID NO: 106 (encoded by, e.g., SEQ ID NO: 105) | 1 |
| SEQ ID NO: 264 (encoded by, e.g., SEQ ID NO: 263) | 0.6 |
| CBH I | 0.05 |
| CBH II | 0.05 |
| SEQ ID NO: 100 (encoded by, e.g., SEQ ID NO: 99) | 1 |
| SEQ ID NO: 96 (encoded by, e.g., SEQ ID NO: 95) | 1 |
| SEQ ID NO: 92 (encoded by, e.g., SEQ ID NO: 91) | 1 |
| SEQ ID NO: 440 (encoded by, e.g., SEQ ID NO: 439) | 1 |
| SEQ ID NO: 442 (encoded by, e.g., SEQ ID NO: 441) | 1 |

This cocktail of 9 enzymes releases 78% and 62% of the theoretical glucose and xylose, respectively, in 48 hrs from an alkaline pretreated corn cob sample. Furthermore, this 9 enzyme cocktail of the invention outperforms an industrial standard—Genencor's SPEZYME® cellulase (Genencor International, Inc., Palo Alto, Calif.) under the same reaction conditions.

The strategy employed here to develop an efficient enzyme cocktail was to screen individual glycosyl hydrolases and non-glycosyl hydrolases on process relevant substrates and then combine them to effect maximal monomer yield. Approximately 150 endoglucanases were screened on crystalline cellulose (AVICEL® Microcrystalline Cellulose (MCC)) and a variety of pretreated corn stover (PCS) samples. The pretreated samples included dilute acid pretreated corn stover (PCS), steam PCS, "high severity" alkaline PCS, "low severity" alkaline PCS, "medium severity" alkaline PCS and alkaline soaked pretreated cobs. Products were analyzed by either a general reducing sugar assay (BCA) or by direct chromatographic detection (e.g. HPLC with a refractive index detector). An example of results from such a screen is shown in FIG. 21. FIG. 21 illustrates in graphic form data showing the release of glucose at 48 h from pretreated corn stover (cob) samples by 20 different endoglucanases.

Figure 22:
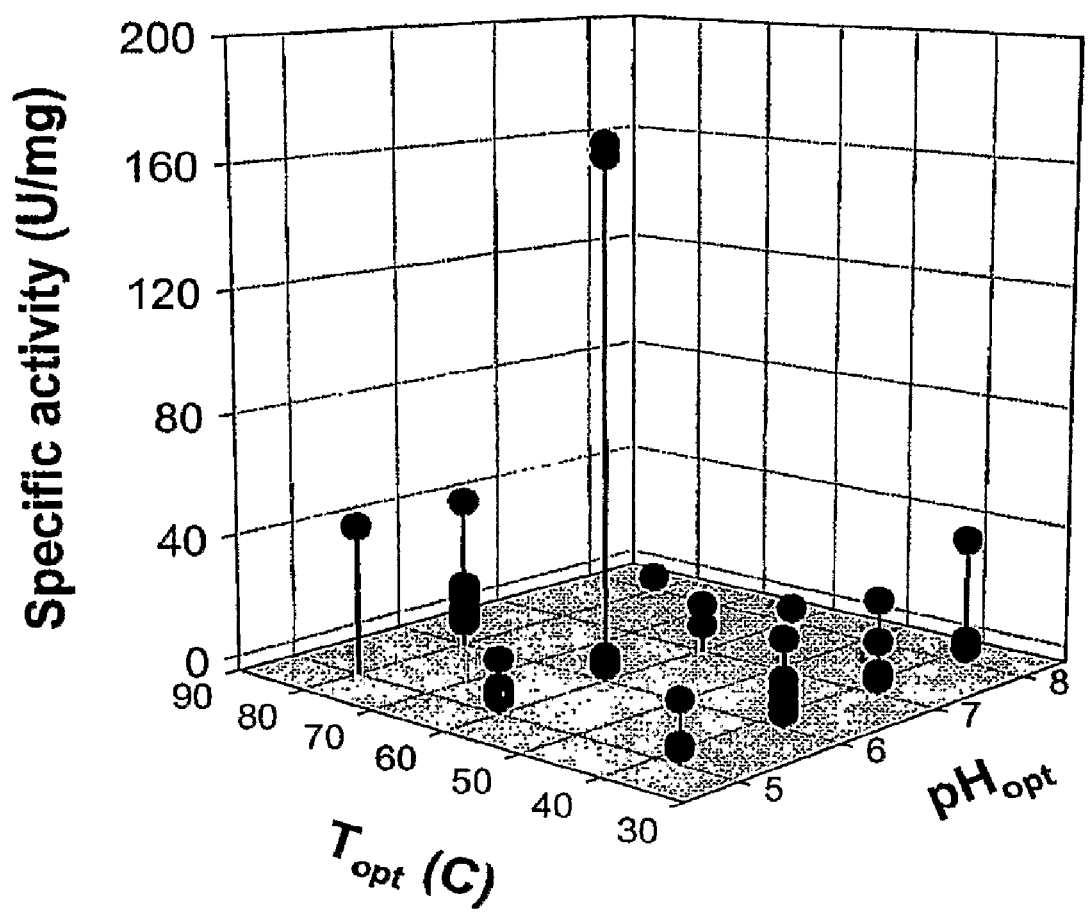
FIG. 22 illustrates data showing temperature and pH optima of 76 β-glucosidases on p-nitrophenyl-β-glucopyranoside, as discussed in detail in Example 5, below.

These experiments identified the exemplary SEQ ID NO:106 (encoded by, e.g., SEQ ID NO:105) as a particularly efficient endoglucanase (see also Example 7, below). Eventually close to 100 enzymes were evaluated as potential components of this exemplary cocktail of the invention. These enzymes were assayed on dye-labeled glucopyranoside at various conditions to determine their optimal pHs and temperatures, as illustrated in FIG. 22. FIG. 22 illustrates in graphic form data showing temperature and pH optima of 76 β-glucosidases on p-nitrophenyl-β-glucopyranoside.

Three enzymes, SEQ ID NO:264 (encoded by, e.g., SEQ ID NO:263), SEQ ID NO:94 (encoded by, e.g., SEQ ID NO:93) and SEQ ID NO:388 (encoded by, e.g., SEQ ID NO:387), had the highest specific activity. However, additional experiments showed that SEQ ID NO:264 (encoded by, e.g., SEQ ID NO:263) had the most activity on the substrate cellobiose. SEQ ID NO:264 (encoded by, e.g., SEQ ID NO:263) showed optimal activity at pH 5 and 80° C. and was chosen as the top candidate β-glucosidase for this exemplary cocktail of the invention.

Cellobiohydrolases (CBHs) are well known in the literature and several are commercially available; two such enzymes CBH I (a family 7 glycosyl hydrolase) and CBH II (a family 6 glycosyl hydrolase) were chosen to be included in this exemplary cocktail of the invention. Fungal CBH I and CBH H (both from *Trichoderma longibrachiatum*) were purchased directly from the enzyme supplier Megazyme International (Bray, Ireland) (catalog numbers E-CBHI and E_CBHII) and included in the cocktails at the standard concentration of 0.05 mg/mL. The addition of the cellobiohydrolases to the cocktail greatly enhanced the overall release of glucose from pretreated corn stover (PCS).

Figure 23:
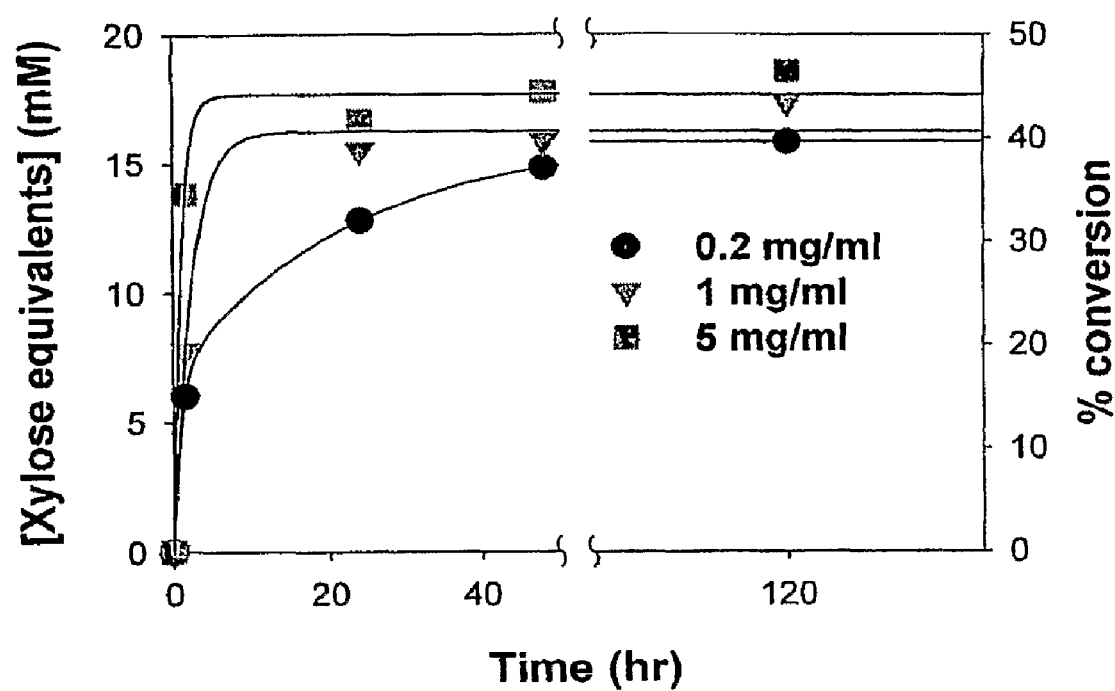
FIG. 23 illustrates data showing the digestion of high severity alkaline pretreated corn stover (PCS) by three different enzyme loads of an exemplary xylanase, as discussed in detail in Example 5, below.

Two xylanases, SEQ ID NO:100 (encoded by, e.g., SEQ ID NO:99) and SEQ ID NO:444 (encoded by, e.g., SEQ ID NO:443), perform well on soluble and insoluble substrates. Both enzymes are family 11 glycosyl hydrolases. SEQ ID NO:444 (encoded by, e.g., SEQ ID NO:443) released close to 50% of the available xylose from high severity alkaline pretreated corn stover (PCS) (see FIG. 23) at pH 5 and 50° C. Increased enzyme dose increases the rate of hydrolysis with little effect on extent. Furthermore it was discovered that SEQ ID NO:100 (encoded by, e.g., SEQ ID NO:99) and SEQ ID NO:444 (encoded by, e.g., SEQ ID NO:443) gave almost equivalent performance. FIG. 23 illustrates in graphic form data showing the digestion of high severity alkaline PCS (2.2% solids) by 3 different enzyme loads of the exemplary xylanase SEQ ID NO:444 (encoded by, e.g., SEQ ID NO:443).

The residual solids isolated after SEQ ID NO:444 (encoded by, e.g., SEQ ID NO:443) digestion were used to screen approx. 250 xylanases. At least six of these screened xylanases were able to further digest this material. All six were family 10 glycosyl hydrolases (see, e.g., Charnock (1998) J. Biol. Chem. 273:32187-32199). These enzymes were subjected to detailed analysis and it was determined that SEQ ID NO:102 (encoded by, e.g., SEQ ID NO:101) and SEQ ID NO:448 (encoded by, e.g., SEQ ID NO:447) were the best performers, at least in this assay.

Figure 24:
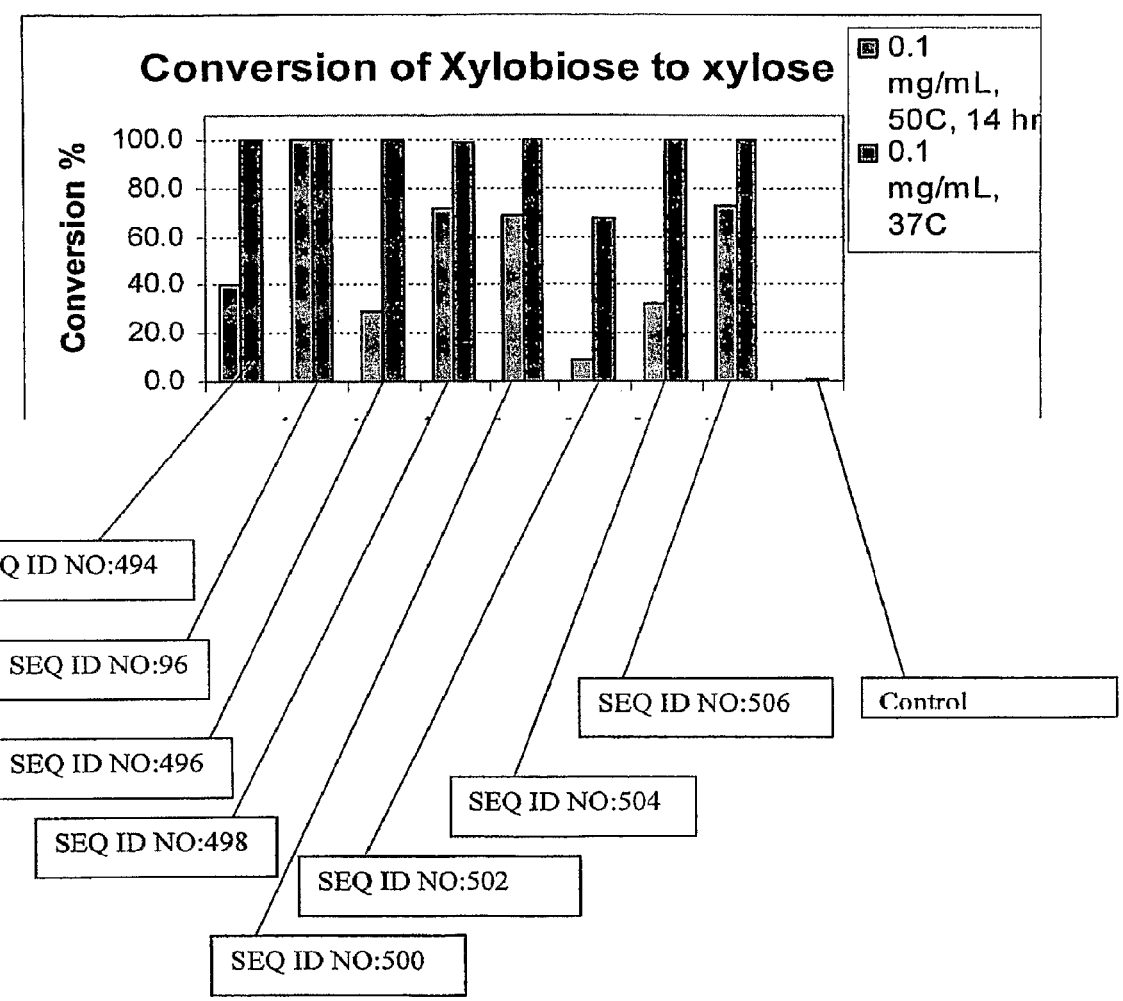
FIG. 24 illustrates data from the hydrolysis of xylobiose by eight xylosidases at either 50° C. or 37° C., as discussed in detail in Example 5, below.

Analysis of the xylanase generated reaction products showed accumulation of soluble xylooligosaccharides (many xylobiose); therefore several β-xylosidases were screened at a variety of temperatures and pHs, and results of which are illustrated in FIG. 24. FIG. 24 illustrates data from the hydrolysis of xylobiose by eight xylosidases at either 50° C. or 37° C.

Figure 25:
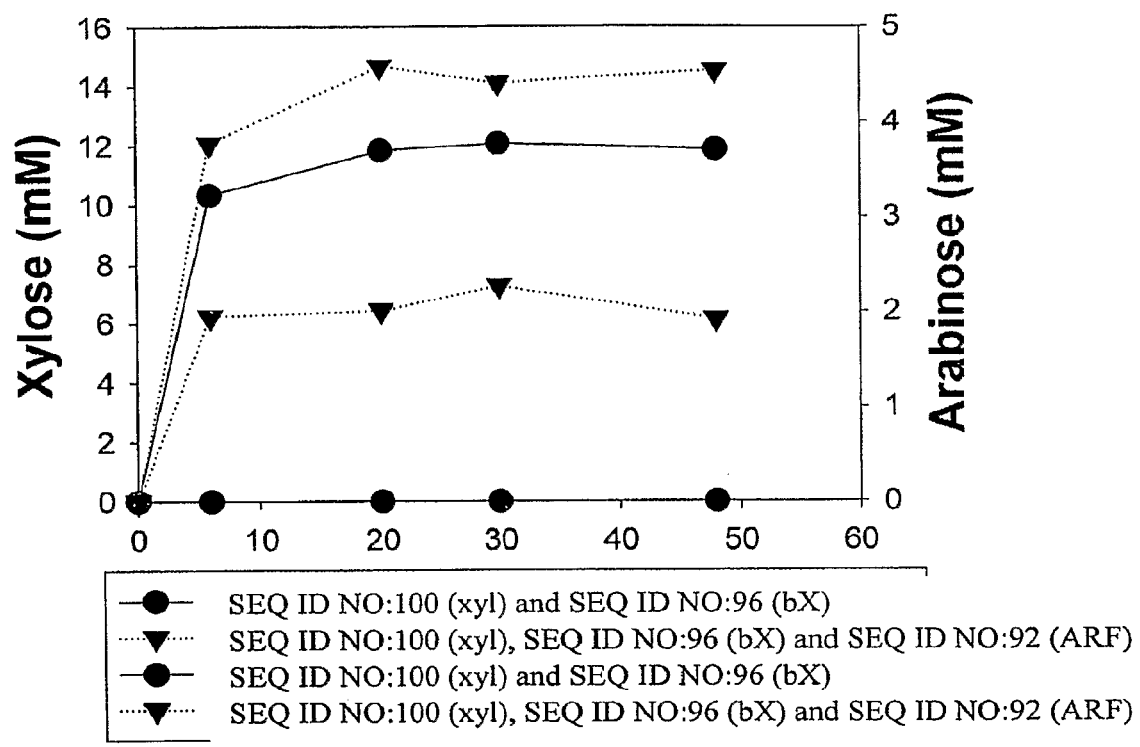
FIG. 25 illustrates data showing the release of xylose and arabinose from high severity alkaline pretreated corn stover (PCS) by combinations of xylanase, xylosidase and arabinofuranosidase, as discussed in detail in Example 5, below.

The exemplary β-xylosidase SEQ ID NO:96 (encoded by, e.g., SEQ ID NO:95) was active and stable at 50° C., therefore was chosen to complement the xylanase. Many other hemicellulases were screened that enhanced the release of xylose from alkaline pretreated corn stover (PCS). As is evident by the results of the data illustrated in FIG. 25, the exemplary arabinofuranosidase SEQ ID NO:92 (encoded by, e.g., SEQ ID NO:91) not only releases arabinose from PCS but enhances the activity of xylanase and xylosidase thereby releasing more xylose. FIG. 25 illustrates data showing the release of xylose and arabinose from high severity alkaline PCS (2.2% solids) by combinations of xylanase, xylosidase and arabinofuranosidase.

The presence of a ferulic acid esterase (FAE) and an α-glucuronidase (aGlucUr) also contributed to enhanced xylose and arabinose release. The exemplary enzymes SEQ ID NO:440 (encoded by, e.g., SEQ ID NO:439) (FAE) and SEQ ID NO:442 (encoded by, e.g., SEQ ID NO:441) (aGlucUr) were identified as the top candidates in this particular application.

The performance of combinations of all the above mentioned enzymes was tested on alkaline pretreated corn stover (PCS) under standard assay conditions (pH 5, 50° C.). Monomer sugar concentrations were measured by HPLC analysis at regular time points during the reaction (6, 20, 30 and 48 hrs). Sugar concentrations were converted into percent conversion based on composition data. FIG. 26 compares the performance of several combinations. Combinations E2 through E9 were tested on "low severity alk PCS" whereas E9.1 is the nine enzyme cocktail tested on alkaline pretreated cobs ("Jaygo 1"). The E9 mixture was made up from crude cell free extracts and was composed of the enzyme cocktail designated "E9", as discussed above and listed in FIG. 26. FIG. 26 lists the enzyme cocktails of the invention designated E2, E4.1, E4.2, E6, E7 and E9. FIG. 26 also illustrates data showing the performance of the E2, E4.1, E4.2, E6, E7 and E9 enzyme cocktails of the invention on low severity alkPCS and alkaline pretreated cobs (2.2% solids). Percent conversion was calculated based on determination of sugar monomer in the soluble fraction and compositional analysis.

The industrial enzyme standard in biomass conversion is SPEZYME® cellulase (also discussed above). FIG. 27 in table form compares data from SPEZYME® cellulase the exemplary enzyme cocktail of the invention designated E9 on four different pretreated corn samples. FIG. 27 illustrates a Table comparing the performance of the exemplary enzyme cocktail E9 to a typical loading (15 Filter Paper Units per gram of cellulase) of SPEZYME® cellulase on a variety of pretreated corn samples (the designations "Jaygo 1", "Jaygo 2" and "Jaygo 4" are cobs and "Jaygo 5" is stover). Sugar concentrations were determined after 48 hr incubation. Clearly the exemplary enzyme cocktail E9 releases more xylose than SPEZYME® cellulase and in most cases releases more glucose.

Enzyme cocktails of the invention also were developed and optimized for performance (e.g., complete hydrolysis of) certain substrates (e.g., lignocellulosic materials) and subsequent yields of glucose and xylose. In one aspect, enzyme cocktails of the invention when incubated with an appropriate pretreated biomass feedstock have the following performance characteristics: in 48 hrs release 75% and 40% of theoretical glucose and xylose, respectively, using 5% solids and 20 mg/g cellulose.

Several different classes of enzymes were combined in appropriate ratios. These cocktails are referred to as "EX" where "X" is the number of enzymes combined. Performance was monitored by reacting the various enzyme cocktails with a pretreated biomass sample and measuring sugars in the liquid phase. In addition, since crude cell free extracts were used in the cocktails it was necessary to develop methodologies to accurately assess the amount of active enzyme present. To this end each enzyme was purified and specific activity of the pure (or enriched) protein was used to estimate the level of active protein in the crude mixture. The table below details performance levels achieved.

| Performance Parameters | Benchmark SPEZYME® enzyme* | Case 1[1] | Case 2[1] | Case 3[1] |
|---|---|---|---|---|
| Mg active enzyme/g cellulose | 20[3] | 18.4 | 19.2 | 17.2 |
| Glucose: % Conversion | 80 | 76 | 79 | 76 |
| Glucose: Time for conversion (hr) | 48 | 48 | 48 | 48 |
| Xylose: % Conversion | 65 | 57[2] | 58[2] | 59[2] |
| Xylose: Time for conversion (hr) | 48 | <20 | <20 | <20 |
| % Solids | 2.5 | 5 | 5 | 5 |

*Performance of SPEZYME® enzyme (15 FPU) on corn stover receiving the 'severe' alkaline pretreatment (15% NH4OH, 170° C., 5 minute residence time) followed by disc-refining (0.010" gap).
**At this point in time we are not monitoring expression levels nor are we attempting to improve specific activity. A more accurate active enzyme amount will be set after year 2 for subsequent years.
[1]Case 1, 2 and 3 are different enzyme combinations. They are explained in the text below.
[2]Yields of xylose reached at the 20 hr time-point. Xylose concentration increases to approximately 63% between 20 and 48 hrs. More data is available in the text below.
[3]Current estimates for 15 FPU Spezyme® cellulase corresponds to approximately 58 mg protein.

Figure 33:
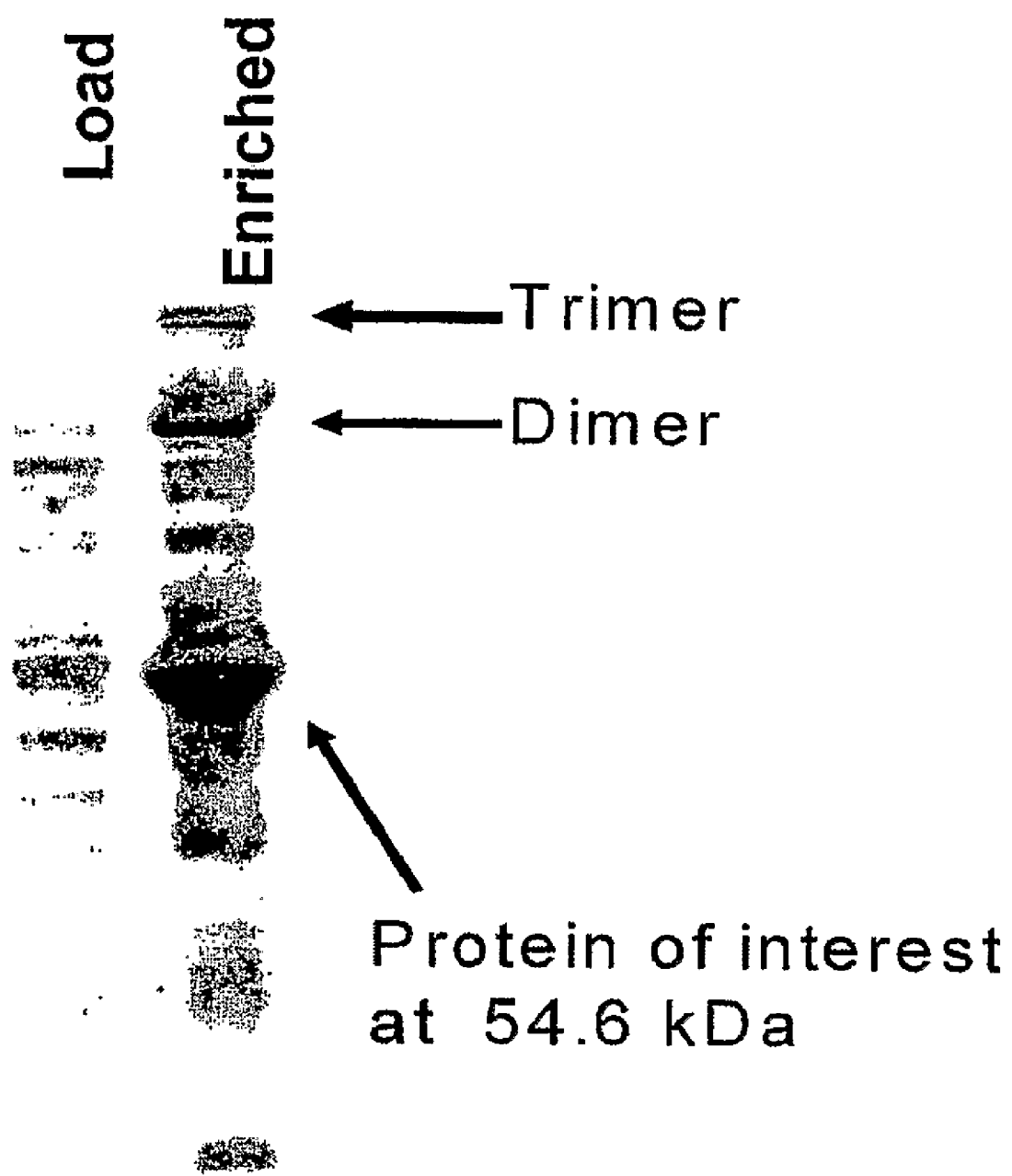
FIG. 33 illustrates an SDS PAGE of a crude cell extract and an enriched (recombinant) exemplary β-glucosidase activity of the invention following anion exchange chromatography; as discussed in detail in Example 5, below.

Protein Purification
List of Enzymes Purified:
SEQ ID NO:264 (encoded by, e.g., SEQ ID NO:263): β-glucosidase
SEQ ID NO:106 (encoded by, e.g., SEQ ID NO:105): endoglucanase
SEQ ID NO:100 (encoded by, e.g., SEQ ID NO:99): family 11 xylanase
SEQ ID NO:102 (encoded by, e.g., SEQ ID NO:101): family 10 xylanase
SEQ ID NO:96 (encoded by, e.g., SEQ ID NO:95): β-xylosidase
SEQ ID NO:92 (encoded by, e.g., SEQ ID NO:91): α-arabinofuranosidase
SEQ ID NO:98 (encoded by, e.g., SEQ ID NO:97): family 6 cellobiohydrolase
SEQ ID NO:34 (encoded by, e.g., SEQ ID NO:33): family 7 cellobiohydrolase
SEQ ID NO:264—β-Glucosidase
β-glucosidase activity of the exemplary enzyme SEQ ID NO:264 (encoded by, e.g., SEQ ID NO:263) was assayed using the colorimetric substrate analog pNP-β-glucopyranoside. Activity was measured by monitoring absorption at 405 nm. The enzyme was purified using anion exchange chromatography resulting in an enrichment of activity from 20.8 U/mg protein to 179 U/mg protein (almost a 9-fold enrichment). SDS-PAGE and densitometry showed that the enriched protein was approximately 48% pure, as illustrated in FIG. 33. Using these two values it was estimated that the original sample contained approximately 5.6% active SEQ ID NO:264 (encoded by, e.g., SEQ ID NO:263). FIG. 33 illustrates an SDS PAGE of the crude cell extract ("Load")

and the enriched protein following anion exchange chromatography ("Enriched"). Proteomics analysis showed that the bands labeled "dimer" and "trimer" are also the exemplary SEQ ID NO:264 (encoded by, e.g., SEQ ID NO:263) and were probably a result of anomalous behavior on SDS-PAGE.

Figure 34:
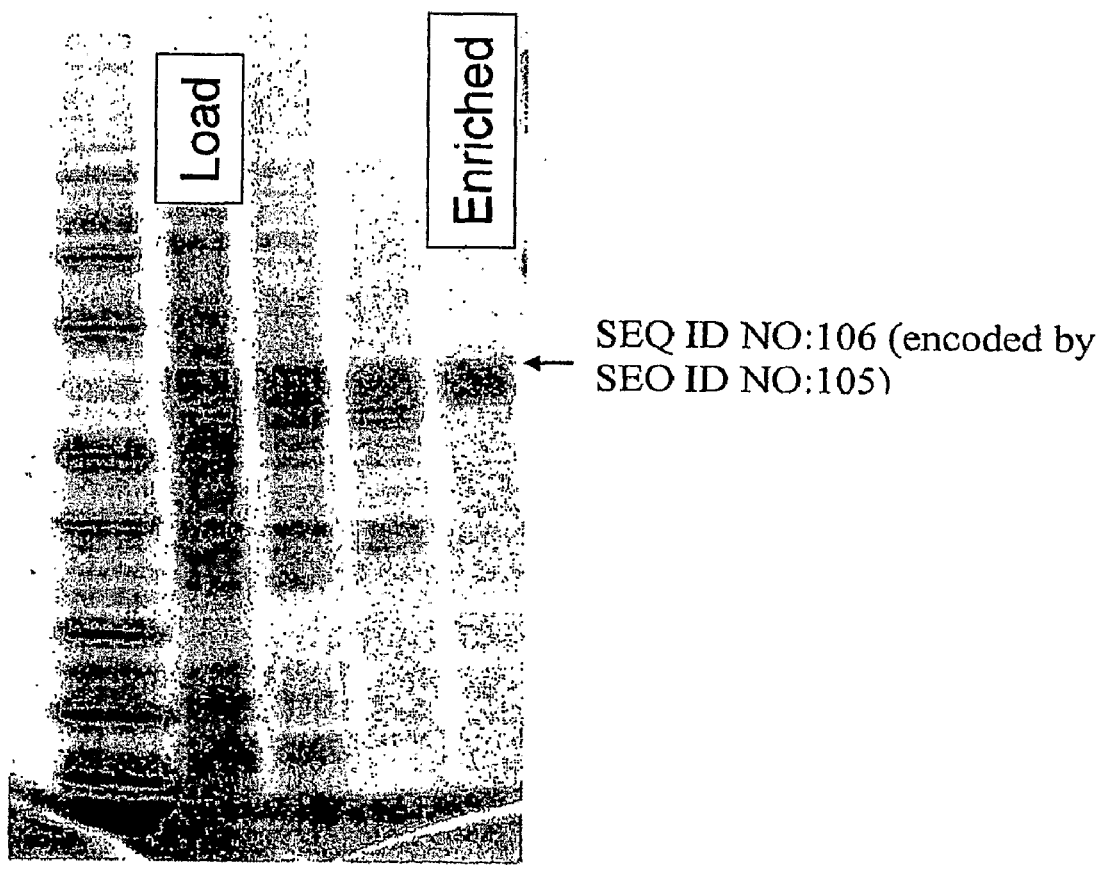
FIG. 34 is an illustration of an SDS PAGE of the crude cell extract and the enriched exemplary β-glucosidase following anion exchange chromatography; as discussed in detail in Example 5, below.

Endoglucanase activity of the exemplary SEQ ID NO:106 (encoded by, e.g., SEQ ID NO:105) also was assayed using the surrogate substrate 4-methylumbeliferyl cellobioside. The enzyme was purified using anion exchange chromatography and heat treatment resulting in an enrichment of activity from $8.4 \times 10^4$ U/mg protein to $3 \times 10^5$ U/mg protein (a 3.6-fold enrichment). SDS-PAGE and densitometry showed that the enriched protein was approximately 10% pure, as illustrated in FIG. 34. Using these two values it was estimated that the original sample contained approximately 3% active SEQ ID NO:106 (encoded by, e.g., SEQ ID NO:105). FIG. 34 is an illustration of an SDS PAGE of the crude cell extract ("Load") and the enriched exemplary SEQ ID NO:106 (encoded by, e.g., SEQ ID NO:105) following anion exchange chromatography ("Enriched").

Figure 35:
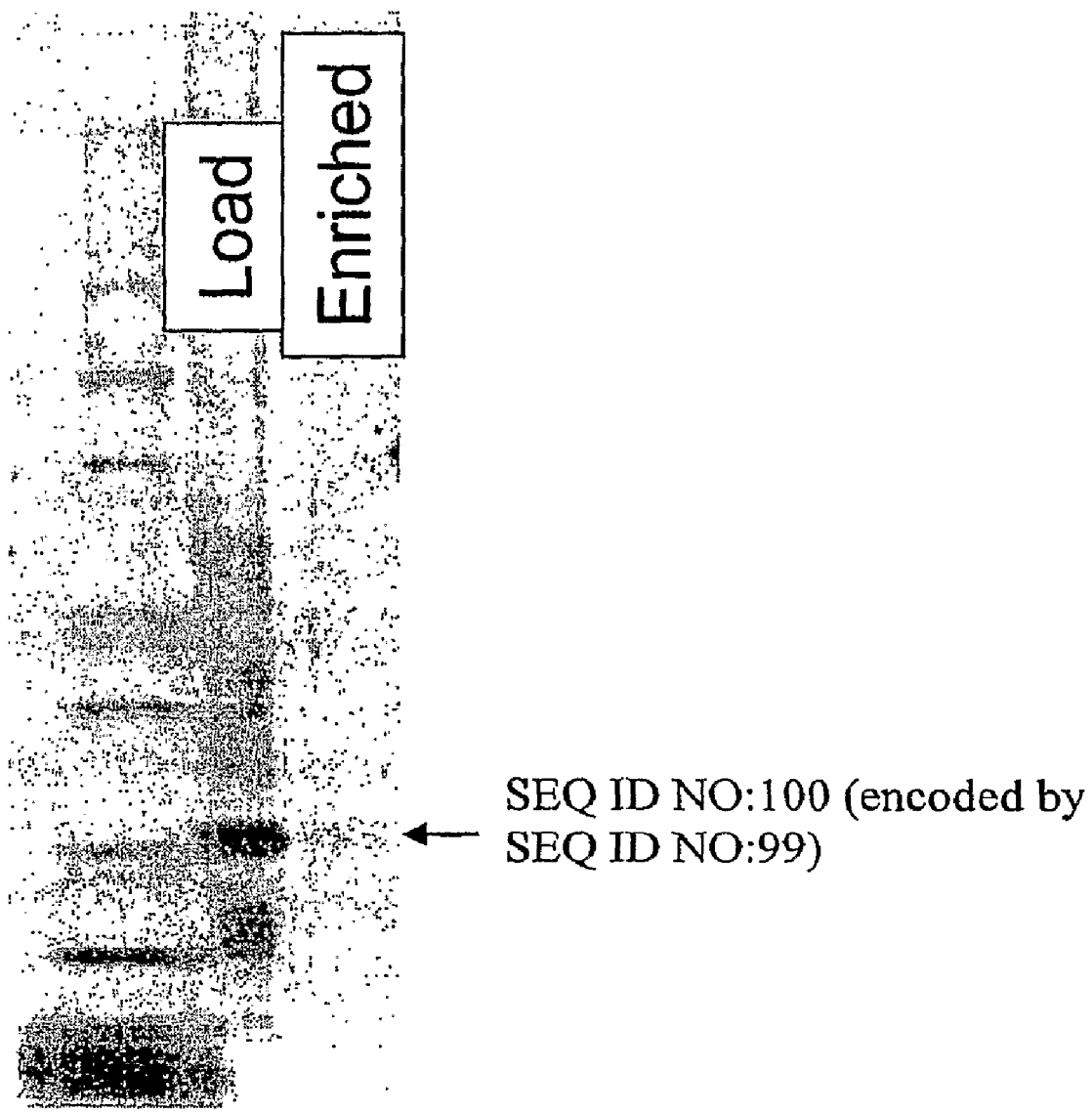
FIG. 35 is an illustration of an SDS PAGE of the crude cell extract and an enriched exemplary xylanase enzyme of the invention following cation exchange chromatography; as discussed in detail in Example 5, below.

Xylanase activity of the exemplary SEQ ID NO:100 (encoded by, e.g., SEQ ID NO:99), characterized as a Family 11 xylanase, was assayed on wheat arabinoxylan with product detection using a reducing sugar assay (BCA). The enzyme was purified using cation exchange chromatography resulting in an enrichment of activity from 41.4 U/mg protein to 215 U/mg protein (a 5-fold enrichment). SDS-PAGE and densitometry showed that the enriched protein was approximately 80% pure, as illustrated in FIG. 35. Using these two values it was estimated that the original sample contained approximately 15.5% active SEQ ID NO:100 (encoded by, e.g., SEQ ID NO:99). FIG. 35 is an illustration of an SDS PAGE of the crude cell extract ("Load") and the enriched exemplary SEQ ID NO:100 (encoded by, e.g., SEQ ID NO:99) protein following cation exchange chromatography ("Enriched").

Figure 36:
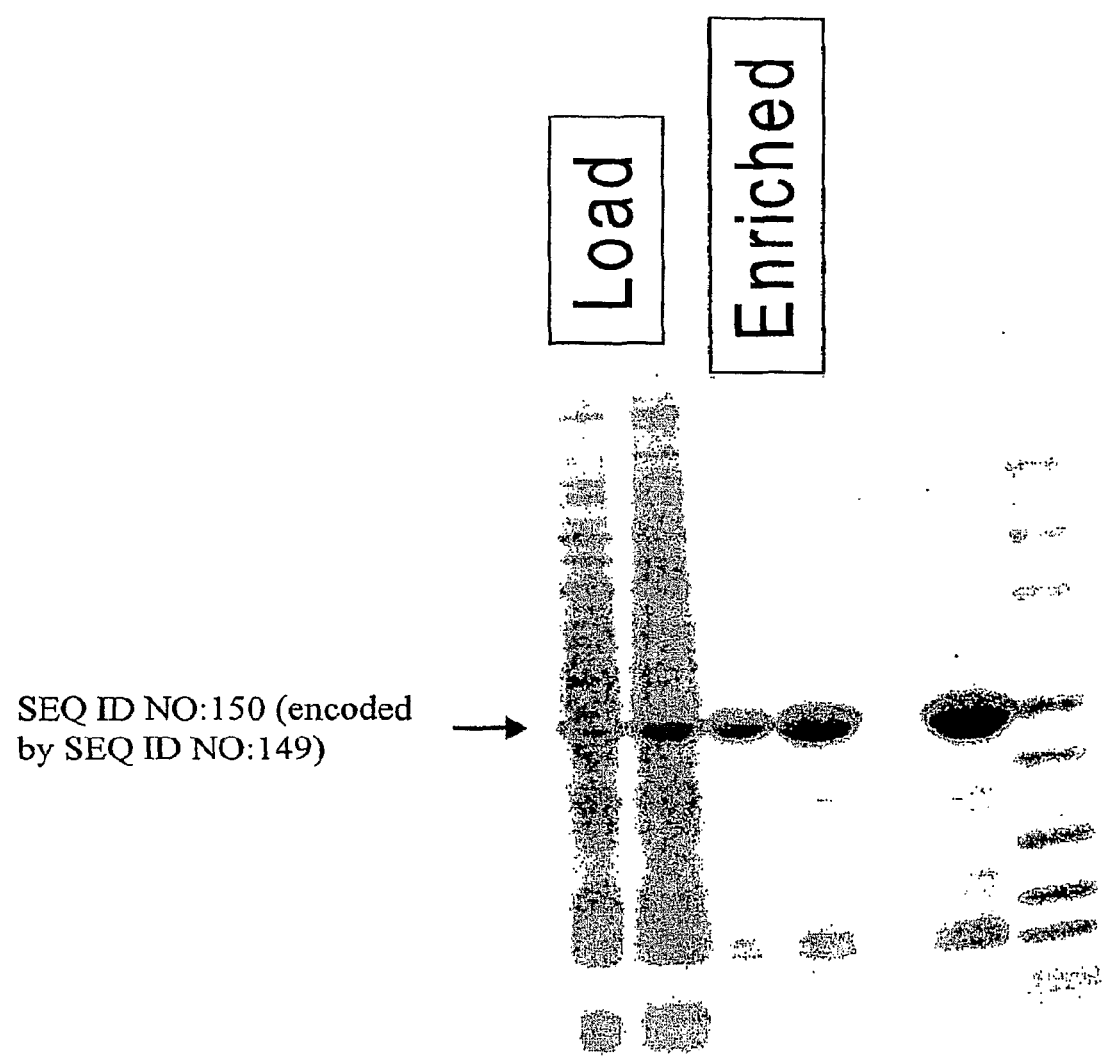
FIG. 36 is an illustration of an SDS PAGE of the crude cell extract and an enriched exemplary xylanase enzyme of the invention following cation exchange chromatography; as discussed in detail in Example 5, below.
Figure 37:
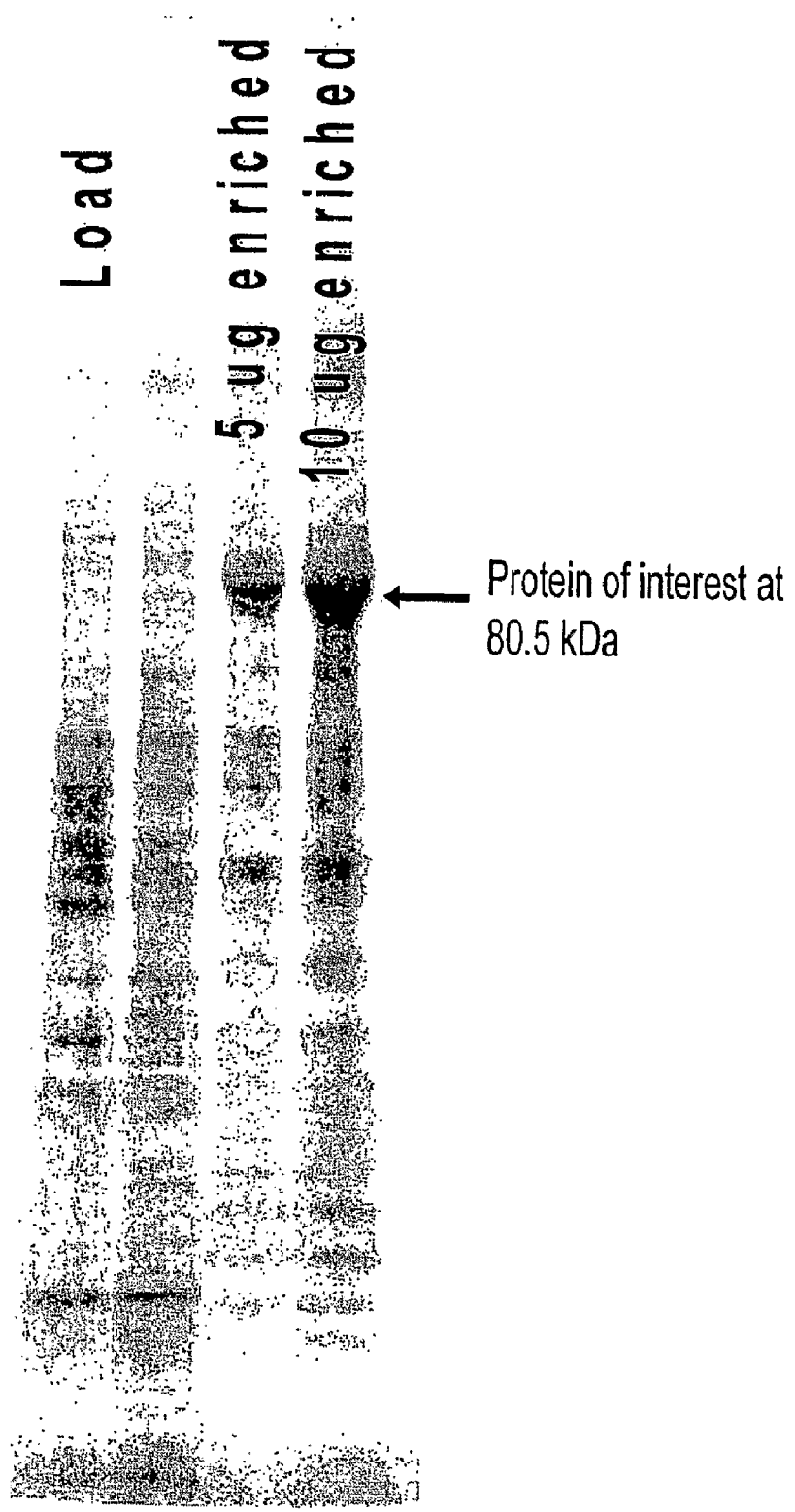
FIG. 37 is an illustration of an SDS PAGE of a crude cell extract and an enriched exemplary enzyme of the invention having β-xylosidase activity following anion exchange chromatography; as discussed in detail in Example 5, below.

Xylanase activity of the exemplary SEQ ID NO:102 (encoded by, e.g., SEQ ID NO:101), characterized as a Family 10 xylanase, was assayed on wheat arabinoxylan with product detection using a reducing sugar assay (BCA). The enzyme was purified using size exclusion chromatography resulting in an enrichment of activity from 10.5 U/mg protein to 42.7 U/mg protein (a 4-fold enrichment). SDS-PAGE and densitometry showed that the enriched protein was approximately 81.5% pure, as illustrated in FIG. 36. Using these two values it was estimated that the original sample contained approximately 18.7% active SEQ ID NO:102 (encoded by, e.g., SEQ ID NO:101). FIG. 36 is an illustration of an SDS PAGE of the crude cell extract ("Load") and the enriched exemplary SEQ ID NO:102 (encoded by, e.g., SEQ ID NO:101) protein following size exclusion chromatography ("Enriched").

β-xylosidase activity of the exemplary SEQ ID NO:96 (encoded by, e.g., SEQ ID NO:95) was assayed using the fluorimetric substrate analog 4-methyl umbelliferyl-β-xylopyranoside. The enzyme was purified using anion exchange chromatography resulting in an enrichment of activity from 6 U/mg protein to 51.2 U/mg protein (an 8.5-fold enrichment). SDS-PAGE and densitometry showed that the enriched protein was approximately 21% pure, as illustrated in FIG. 37. Using these two values it was estimated that the original sample contained approximately 2.7% active exemplary SEQ ID NO:96 (encoded by, e.g., SEQ ID NO:95). FIG. 37 is an illustration of an SDS PAGE of the crude cell extract ("Load") and the enriched exemplary SEQ ID NO:96 (encoded by, e.g., SEQ ID NO:95) protein having β-xylosidase activity following anion exchange chromatography ("Enriched").

Figure 38:
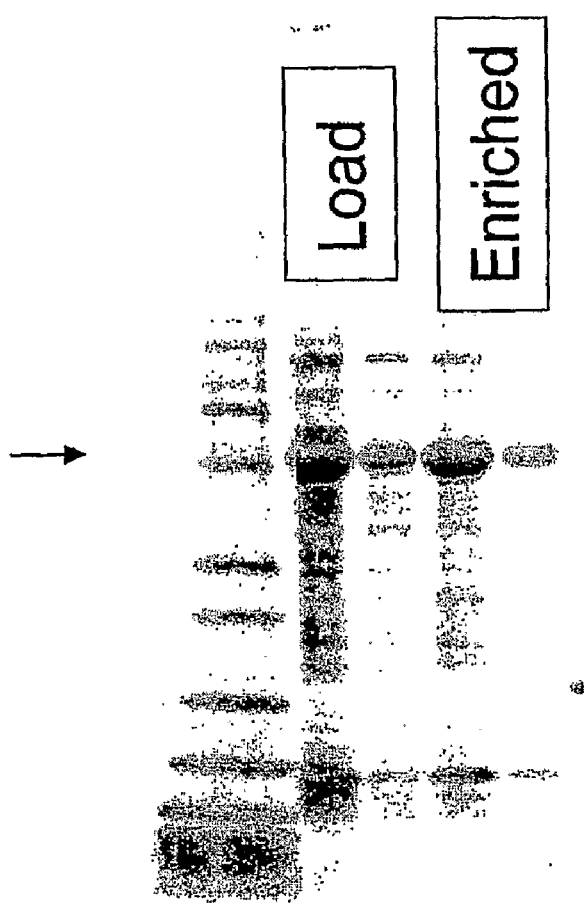
FIG. 38 is an illustration of an SDS PAGE of a crude cell extract and enriched exemplary enzyme of the invention having arabinofuranosidase activity following anion exchange chromatography; as discussed in detail in Example 5, below.

Arabinofuranosidase activity of the exemplary SEQ ID NO:92 (encoded by, e.g., SEQ ID NO:91) was assayed using the fluorimetric substrate analog 4-methyl umbelliferyl-α-arabinofuranoside. The enzyme was purified using anion exchange chromatography resulting in an enrichment of activity from $7.2 \times 10^6$ U/mg protein to $9.8 \times 10^6$ U/mg protein (a 1.4-fold enrichment). SDS-PAGE and densitometry showed that the enriched protein was approximately 50% pure, as illustrated in FIG. 38. Using these two values it was estimated that the original sample contained approximately 34% active SEQ TD NO:92 (encoded by, e.g., SEQ ID NO:91). FIG. 38 is an illustration of an SDS PAGE of the crude cell extract ("Load") and the enriched exemplary SEQ ID NO:92 (encoded by, e.g., SEQ ID NO:91) protein having arabinofuranosidase activity following anion exchange chromatography ("Enriched").

Figure 39:
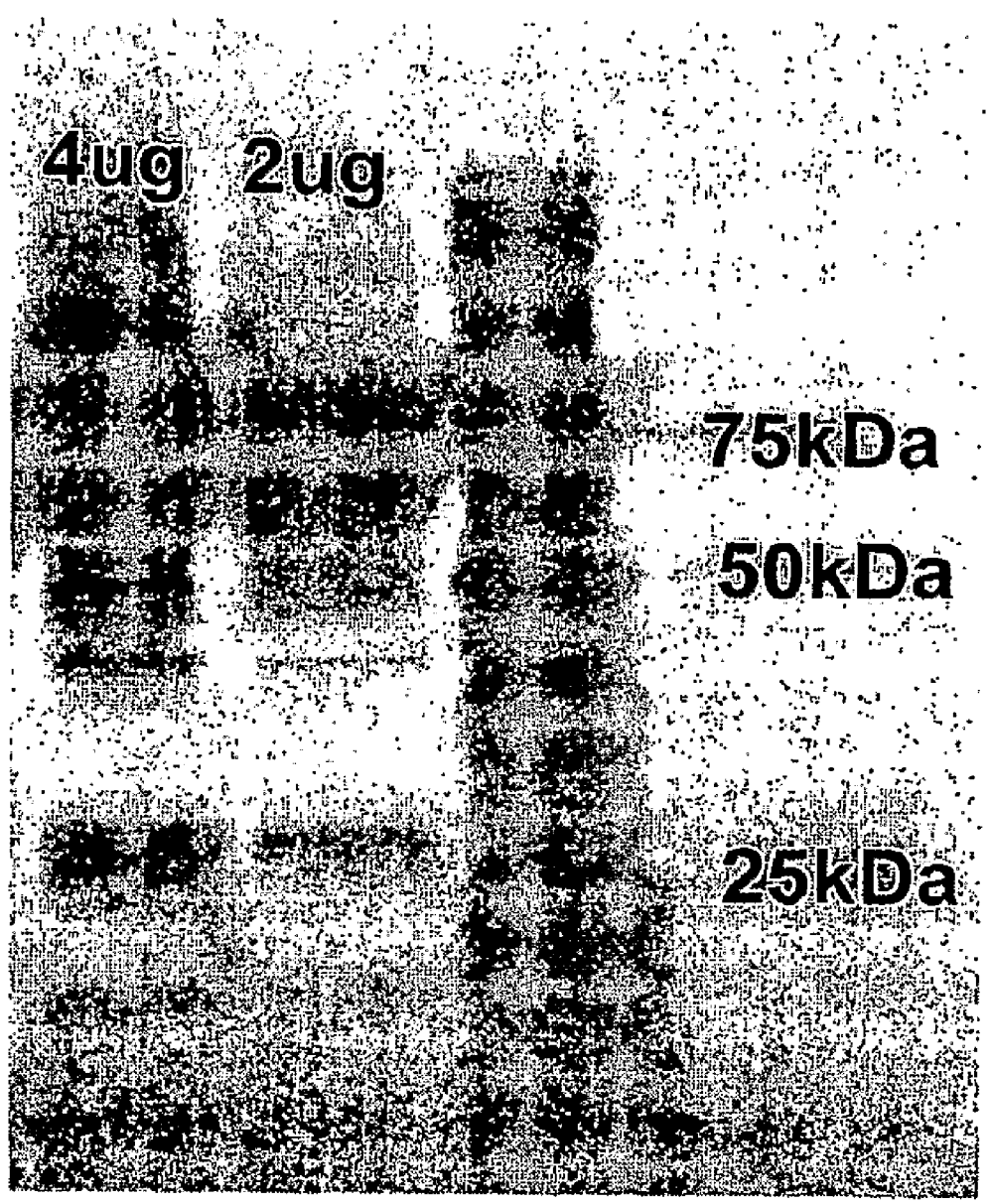
FIG. 39 is an illustration of an SDS-PAGE of an exemplary enzyme of the invention having cellobiohydrolase activity enriched on a PAGE affinity ligand; as discussed in detail in Example 5, below.

Cellobiohydrolase activity of the exemplary SEQ ID NO:98 (encoded by, e.g., SEQ ID NO:97), a family 6 cellobiohydrolase, was assayed on phosphoric acid swollen cellulose (PASC). Product was detected by a coupled assay with β-glucosidase, glucose oxidase and horseradish peroxidase. The enzyme was purified from the secreted protein of a *Cochliobolus heterostrophus* strain containing the CBH gene inserted into the chromosome. An affinity ligand, p-aminophenyl-β-cellobioside, was developed to isolate the protein from endogenous protein. SDS-PAGE and densitometry showed that the enriched protein was approximately 46% pure, as illustrated in FIG. 39. FIG. 39 is an illustration of an SDS-PAGE of the exemplary SEQ ID NO:98 (encoded by, e.g., SEQ ID NO:97) having cellobiohydrolase activity enriched on a PAPC affinity ligand.

Figure 40:
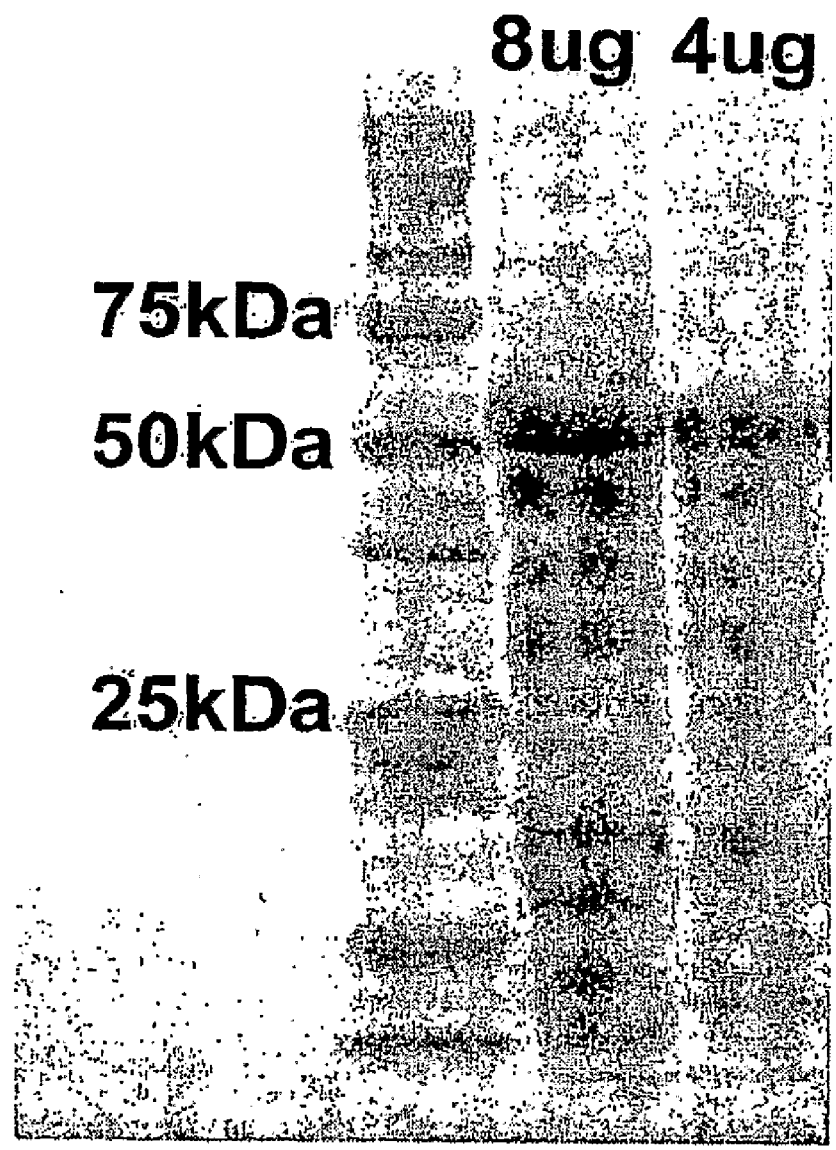
FIG. 40 is an illustration of an SDS-PAGE of the exemplary family 7 cellobiohydrolase of the invention enriched on size exclusion chromatography; as discussed in detail in Example 5, below.

Unlike the family 6 cellobiohydrolases, family 7 cellobiohydrolase enzymes are active on the dye labeled substrate analog 4-methyl umbelliferyl-p-lactoside, therefore the exemplary SEQ ID NO:34 (encoded by, e.g., SEQ ID NO:33) was assayed on this substrate. The enzyme was purified from the secreted protein of a *Cochliobolus heterostrophus* strain containing the CBH gene inserted into the chromosome. Size exclusion chromatography was used to separate SEQ ID NO:34 (encoded by, e.g., SEQ ID NO:33) from endogenous proteins. SDS-PAGE and densitometry showed that the enriched protein was approximately 20% pure, as illustrated in FIG. 40. FIG. 40 is an illustration of an SDS-PAGE of the exemplary family 7 cellobiohydrolase SEQ ID NO:34 (encoded by, e.g., SEQ ID NO:33) enriched on size exclusion chromatography.

*Trichoderma reesei* CBH I and II: Megazyme International (Bray, Ireland) sells preparations of *T. reesei* I and II. SDS-PAGE was used to estimate the level of purity for each of these enzymes. Prior to use they were dialyzed to remove ammonium sulfate present in the preparations. The Table below summarizes the results of purification of each enzyme and the approximate percent active enzyme used in the cocktails. The table below lists an exemplary enzyme cocktail used as biomass-degrading cocktails, and the table lists estimated percent of active enzyme in crude preparations.

| Enzyme | % active enzyme |
| --- | --- |
| SEQ ID NO: 264 (encoded by, e.g., SEQ ID NO: 263) | 5.6 |
| SEQ ID NO: 106 (encoded by, e.g., SEQ ID NO: 105) | 3 |
| SEQ ID NO: 100 (encoded by, e.g., SEQ ID NO: 99) | 15.5 |
| SEQ ID NO: 102 (encoded by, e.g., SEQ ID NO: 101) | 18.7 |
| SEQ ID NO: 96 (encoded by, e.g., SEQ ID NO: 95) | 2.7 |
| SEQ ID NO: 92 (encoded by, e.g., SEQ ID NO: 91) | 34 |
| SEQ ID NO: 98 (encoded by, e.g., SEQ ID NO: 97) | 46 |
| SEQ ID NO: 34 (encoded by, e.g., SEQ ID NO: 33) | 20 |
| Tr CBH I | 87 |
| Tr CBH II | 51 |

Enzymatic digestion of pretreated biomass: In all the studies shown below the pretreated biomass sample was designated "Jaygo 2" (5% solids pretreated corn cob). The composition of "Jaygo 2" was determined and is shown in the Table, below. These values were used to calculate percent conversion during enzymatic hydrolysis. The table lists the composition of "Jaygo 2" and theoretical concentration of glucose and xylose after 100% conversion of 5% solids reaction

|  | Percent composition | Ratio (liquid/solid) | Total | Theoretical 100% conversion (5% solids) | |
|---|---|---|---|---|---|
|  |  |  |  | (g/L) | (mM) |
| Glucan | 42.9 | 0.010 | 43.33 | 21.67 | 120.37 |
| Xylan | 31.22 | 0.084 | 33.85 | 16.93 | 112.84 |

Figure 41:
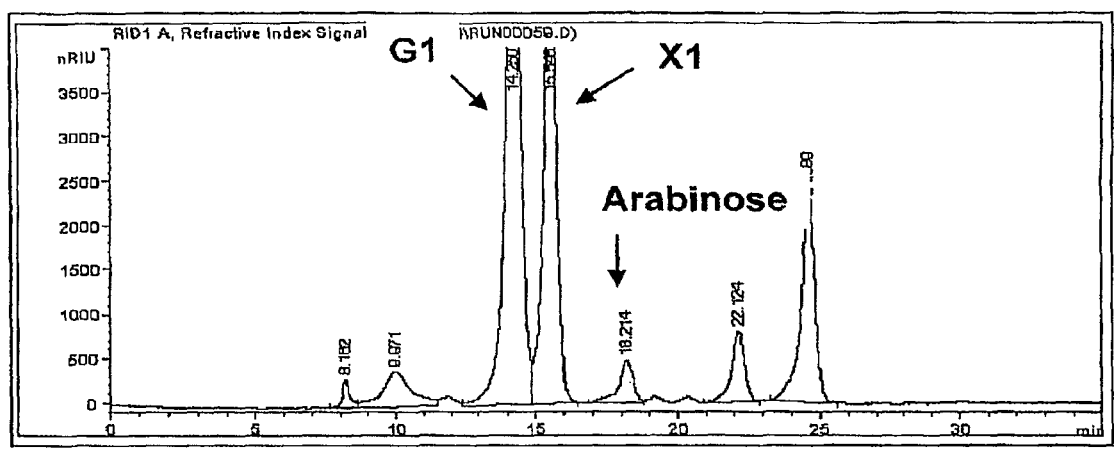
FIG. 41 is an illustration of a chromatogram that is a representative HPLC trace of the products of biomass digestion by exemplary enzymes of the invention; as discussed in detail in Example 5, below.

Each reaction was sampled at various time points and product concentration was determined by HPLC-RI. An example of a chromatogram is shown in an illustration shown as FIG. 41; a representative HPLC trace of the products of biomass digestion. Production detection was by refractive index. In FIG. 41 G1 is glucose and X1 is xylose.

Figure 42:
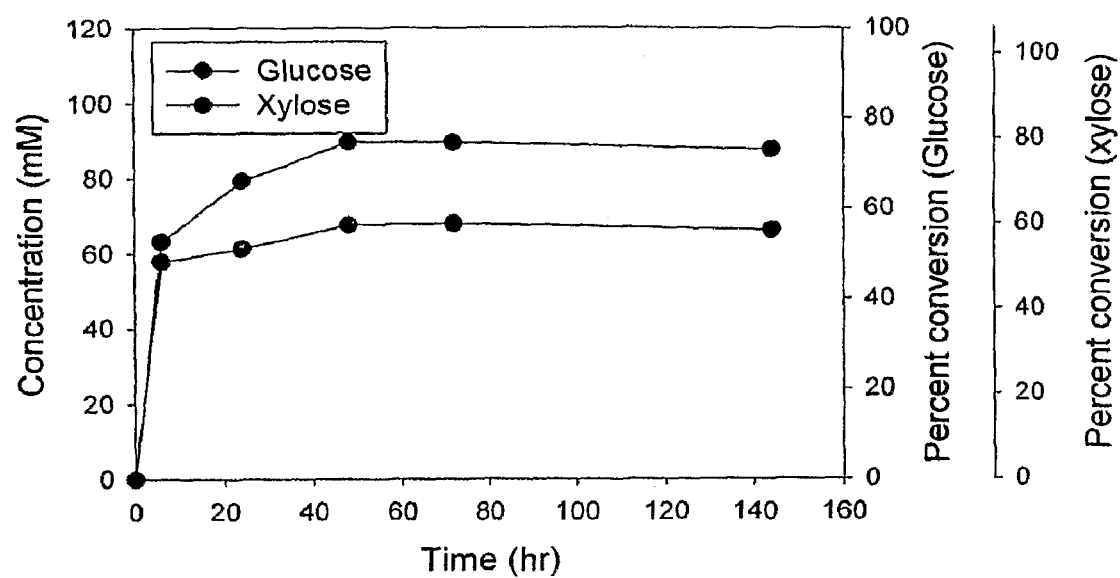
FIG. 42 graphically illustrates data obtained from cellulase digestion using exemplary enzymes of the invention using 5% solids in both absolute concentration and percent conversion; as discussed in detail in Example 5, below.
Figure 43:
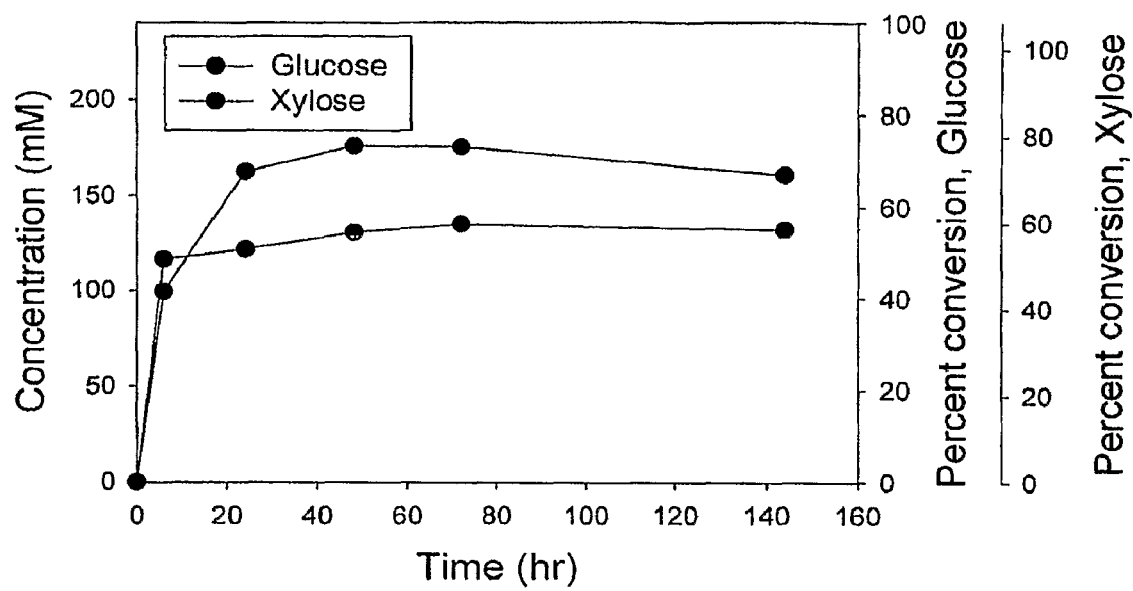
FIG. 43 graphically illustrates data from the digestion of 10% solids using a commercial cellulose plus 7.5 "FPU equivalents"/g commercial xylanase; as discussed in detail in Example 5, below.

In order to directly compare activity performance of exemplary enzymes of the invention to a commercial benchmark, SPEZYME® was used in these studies, cellulase performance was tested under the same conditions. The standard dosage of SPEZYME® cellulose of 15 FPU/g cellulose is equivalent to 58 mg protein/g cellulose. In the following experiments 7.5 FPU cellulase (29 mg) was combined with the protein equivalent of MULTIFECT® xylanase for a total of 58 mg/g cellulose. FIG. 42 graphically illustrates data obtained from cellulase digestion using exemplary enzymes of the invention using 5% solids (Jaygo 2) (5% solids pretreated corn cob) in both absolute concentration and percent conversion. In the assay shown in FIG. 42, digestion of Jaygo 2 (5% solids) using 7.5 FPU/g cellulose SPEZYME® cellulase plus 7.5 "FPU equivalents"/g cellulose MULTIFECT® xylanase (in total 58 mg/g cellulose). Percent conversion was based on 120 mM glucose and 113 mM xylose as 100%. FIG. 43 shows the data set for 10% solids. FIG. 43 graphically illustrates data from the digestion of Jaygo 2 (10% solids) using 7.5 FPU/g cellulose SPEZYME® cellulase plus 7.5 "FPU equivalents"/g cellulose MULTIFECT® xylanase (in total 58 mg/g cellulose). Percent conversion was based on 240 mM glucose and 226 mM xylose as 100%.

Therefore benchmark performance is:

| Performance Parameters | Benchmark SPEZYME ® enzyme | Benchmark SPEZYME ® enzyme |
|---|---|---|
| mg active enzyme/g cellulose | 58 | 58 |
| Glucose: % Conversion | 75 | 73 |
| Glucose: Time for conversion (hr) | 48 | 48 |
| Xylose: % Conversion | 59 | 57 |
| Xylose: Time for conversion (hr) | 48 | 48 |
| % Solids | 5 | 10 |

Enzymes of the Invention—5% Solids

A cocktail of 10 enzymes (so-called the exemplary "E10" cocktail) which showed very high biomass saccharification activity was developed. Four of the enzymes are responsible for digesting cellulose while the remainder are active on hemicellulose. As described above, a combination of protein purification, SDS-PAGE analysis and enzyme assays allowed a quantitative measure of the amount of active enzyme in each of the crude preparations. In order to reduce overall protein used in saccharification reactions, a systematic approach was undertaken to remove redundant and unnecessary enzymes from the E10 cocktail. It was determined that 2 of the enzymes, SEQ ID NO:442 (encoded by, e.g., SEQ ID NO:441) (an α-glucuronidase) and SEQ ID NO:440 (encoded by, e.g., SEQ ID NO:439) (a ferulic acid esterase) contributed very little to overall performance and were removed from the cocktail, resulting in an E8 mixture. Finally, experiments were carried out to determine which of the cellobiohydrolases (CBH I, CBH II, SEQ ID NO:98 (encoded by, e.g., SEQ ID NO:97) and SEQ ID NO:34 (encoded by, e.g., SEQ ID NO:33)) were the most effective. The performance from three different mixes was assessed. The composition of each of these mixes is shown in the tables below (Case 1, 2 and 3). The tables show how much of each enzyme was used in the cocktails and estimates of active enzyme in each of these preparations (expressed in mg enzyme/g cellulose). In all three cases the total enzyme composition was tabulated and was below the 20 mg/g cellulose limited outlined in the target (case 1=18.4 mg/g; case 2=19.2 mg/g and case 3=17.2 mg/g).

| | Case 1 (CBH I/CBH II) E8 Cocktail | | | | | | | | |
|---|---|---|---|---|---|---|---|---|---|
| | Components | % of powder | powder mg/mL | Enzymes mg/mL | substrate mg/mL | Glucan % | Total g cellulose | Total enzyme (mg/g cellulose) | Enzyme % | Pure enzyme (mg/g cellulose) |
| 1 | SEQ ID NO: 106 (encoded by SEQ ID NO: 105) | 0.63 | 2 | 1.3 | 50 | 0.4333 | 0.0217 | 58.2 | 3.00% | 1.7 |
| 2 | SEQ ID NO: 264 (encoded by SEQ ID N0: 263) | 0.67 | 1.5 | 1.0 | 50 | 0.4333 | 0.0217 | 46.4 | 5.60% | 2.6 |
| 3 | CBH I* | 1 | 0.25 | 0.3 | 50 | 0.4333 | 0.0217 | 11.5 | 87.00% | 10.0 |
| 4 | CBH II** | 1 | 0.1 | 0.1 | 50 | 0.4333 | 0.0217 | 4.6 | 51.00% | 2.4 |
| 5 | SEQ ID NO: 100 (encoded by SEQ ID NO: 99) | 0.9 | 0.1 | 0.1 | 50 | 0.4333 | 0.0217 | 4.2 | 15.50% | 0.6 |
| 6 | SEQ ID NO: 96 (encoded by SEQ ID NO: 95) | 0.81 | 0.5 | 0.4 | 50 | 0.4333 | 0.0217 | 18.7 | 2.70% | 0.5 |

-continued

Case 1 (CBH I/CBH II)
E8 Cocktail

| | Components | % of powder | powder mg/mL | Enzymes mg/mL | substrate mg/mL | Glucan % | Total g cellulose | Total enzyme (mg/g cellulose) | Enzyme % | Pure enzyme (mg/g cellulose) |
|---|---|---|---|---|---|---|---|---|---|---|
| 7 | SEQ ID NO: 92 (encoded by SEQ ID NO: 91) | 0.74 | 0.025 | 0.0 | 50 | 0.4333 | 0.0217 | 0.9 | 34.00% | 0.3 |
| 8 | SEQ ID NO: 440 (encoded by SEQ ID NO: 439) | 1 | 0 | 0.0 | 50 | 0.4333 | 0.0217 | 0.0 | 5.00% | 0.0 |
| 9 | SEQ ID NO: 442 (encoded by SEQ ID NO: 441) | 1 | 0 | 0.0 | 50 | 0.4333 | 0.0217 | 0.0 | 5.00% | 0.0 |
| 10 | SEQ ID NO: 102 (encoded by SEQ ID NO: 101) | 1 | 0.025 | 0.0 | 50 | 0.4333 | 0.0217 | 1.2 | 18.70% | 0.2 |
| | TOTAL | | | | | | | | | 18.4 |

Case 2 (CBH I/SEQ ID NO: 98 (encoded by, e.g., SEQ ID NO: 97))
E8 Cocktail

| | Components | % of powder | powder mg/mL | Enzymes mg/mL | substrate mg/mL | Glucan % | Total g cellulose | Total enzyme (mg/g cellulose) | Enzyme % | Pure enzyme (mg/g cellulose) |
|---|---|---|---|---|---|---|---|---|---|---|
| 1 | SEQ ID NO: 106 (encoded by SEQ ID NO: 105) | 0.63 | 2 | 1.3 | 50 | 0.4333 | 0.0217 | 58.2 | 3.00% | 1.7 |
| 2 | SEQ ID NO: 264 (encoded by SEQ ID NO: 263) | 0.67 | 1.5 | 1.0 | 50 | 0.4333 | 0.0217 | 46.4 | 5.60% | 2.6 |
| 3 | CBH I* | 1 | 0.25 | 0.3 | 50 | 0.4333 | 0.0217 | 11.5 | 87.00% | 10.0 |
| 4 | SEQ ID NO: 98 (encoded by SEQ ID NO: 297) | 1 | 0.15 | 0.2 | 50 | 0.4333 | 0.0217 | 6.9 | 46.00% | 3.2 |
| 5 | SEQ ID NO: 100 (encoded by SEQ ID NO: 99) | 0.9 | 0.1 | 0.1 | 50 | 0.4333 | 0.0217 | 4.2 | 15.50% | 0.6 |
| 6 | SEQ ID NO: 96 (encoded by SEQ ID NO: 95) | 0.81 | 0.5 | 0.4 | 50 | 0.4333 | 0.0217 | 18.7 | 2.70% | 0.5 |
| 7 | SEQ ID NO: 92 (encoded by SEQ ID NO: 91) | 0.74 | 0.025 | 0.0 | 50 | 0.4333 | 0.0217 | 0.9 | 34.00% | 0.3 |
| 8 | SEQ ID NO: 440 (encoded by SEQ ID NO: 439) | 1 | 0 | | | 0.4333 | 0.000 | | 5.00% | |
| 9 | SEQ ID NO: 442 (encoded by SEQ ID NO: 441) | 1 | 0 | | | 0.4333 | 0.000 | | 5.00% | |
| 10 | SEQ ID NO: 102 (encoded by SEQ ID NO: 101) | 1 | 0.025 | 0.0 | 50 | 0.4333 | 0.0217 | 1.2 | 18.70% | 0.2 |
| | TOTAL | | | | | | | | | 19.2 |

Case 3 (SEQ ID NO: 34 (encoded by, e.g., SEQ ID NO: 33)/SEQ ID NO: 98 (encoded by, e.g., SEQ ID NO: 97))
E8 Cocktail

| | Components | % of powder | powder mg/mL | Enzymes mg/mL | substrate mg/mL | Glucan % | Total g cellulose | Total enzyme (mg/g cellulose) | Enzyme % | Pure enzyme (mg/g cellulose) |
|---|---|---|---|---|---|---|---|---|---|---|
| 1 | SEQ ID NO: 106 (encoded by SEQ ID NO: 105) | 0.63 | 2 | 1.260 | 50 | 0.4333 | 0.0217 | 58.2 | 3.00% | 1.7 |
| 2 | SEQ ID NO: 264 (encoded by SEQ ID NO: 263) | 0.67 | 1.5 | 1.005 | 50 | 0.4333 | 0.0217 | 46.4 | 5.60% | 2.6 |
| 3 | SEQ ID NO: 34 (encoded by SEQ ID NO: 33) | 1 | 0.75 | 0.750 | 50 | 0.4333 | 0.0217 | 34.6 | 20.00% | 6.9 |
| 4 | SEQ ID NO: 98 (encoded by SEQ ID NO: 297) | 1 | 0.2 | 0.200 | 50 | 0.4333 | 0.0217 | 9.2 | 46.00% | 4.2 |
| 5 | SEQ ID NO: 100 (encoded by SEQ ID N0: 99) | 0.9 | 0.1 | 0.090 | 50 | 0.4333 | 0.0217 | 4.2 | 15.50% | 0.6 |

-continued

Case 3 (SEQ ID NO: 34 (encoded by, e.g., SEQ ID NO: 33)/SEQ ID NO: 98 (encoded by, e.g., SEQ ID NO: 97))
E8 Cocktail

| Components | % of powder | powder mg/mL | Enzymes mg/mL | substrate mg/mL | Glucan % | Total g cellulose | Total enzyme (mg/g cellulose) | Enzyme % | Pure enzyme (mg/g cellulose) |
|---|---|---|---|---|---|---|---|---|---|
| 6 SEQ ID NO: 96 (encoded by SEQ ID NO: 95) | 0.81 | 0.5 | 0.405 | 50 | 0.4333 | 0.0217 | 18.7 | 2.70% | 0.5 |
| 7 SEQ ID NO: 92 (encoded by SEQ ID NO: 91) | 0.74 | 0.025 | 0.019 | 50 | 0.4333 | 0.0217 | 0.9 | 34.00% | 0.3 |
| 8 SEQ ID NO: 440 (encoded by SEQ ID NO: 439) | 1 | 0 | 0.000 | 50 | 0.4333 | 0.0217 | 0.0 | 5.00% | 0.0 |
| 9 SEQ ID NO: 442 (encoded by SEQ ID NO: 441) | 1 | 0 | | | 0.4333 | 0.000 | | 5.00% | |
| 10 SEQ ID NO: 102 (encoded by SEQ ID NO: 101) | 1 | 0.025 | 0.0 | 50 | 0.4333 | 0.0217 | 1.2 | 18.70% | 0.2 |
| TOTAL | | | | | | | | | 17.2 |

Figure 44:
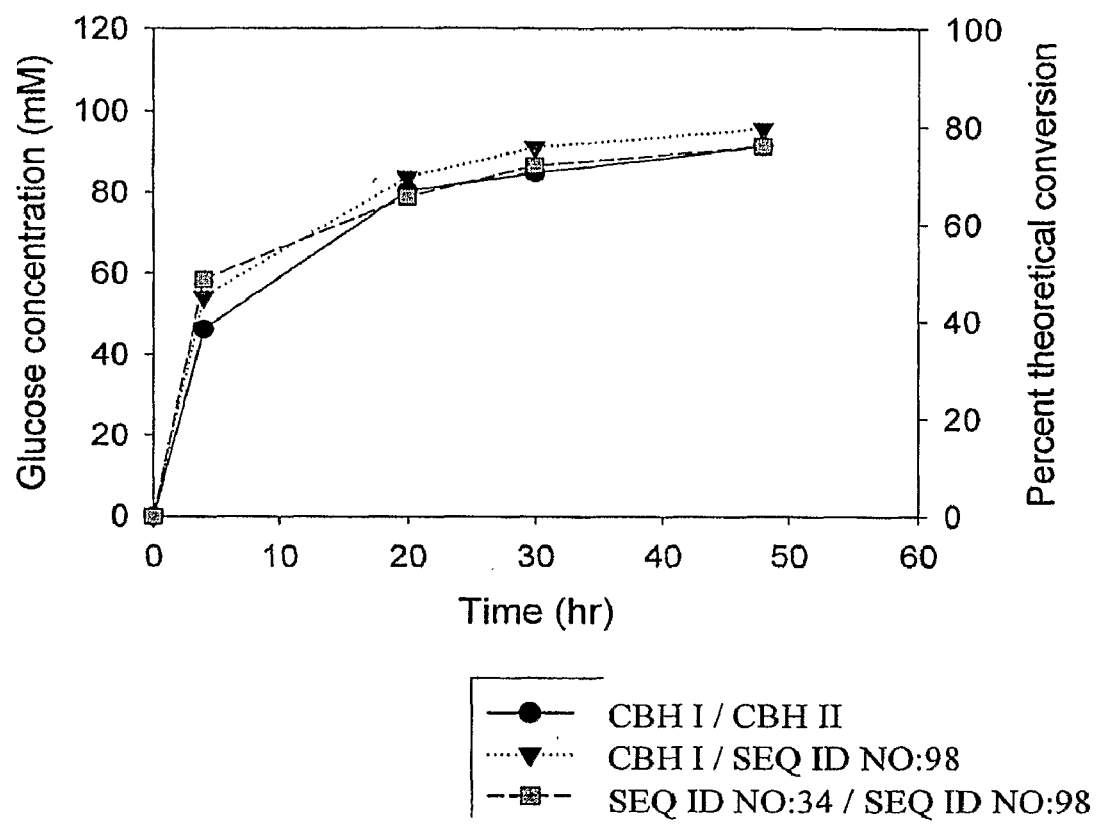
FIG. 44 and FIG. 45 each graphically illustrates data demonstrating glucose release from a 5% cellulose solids composition catalyzed by three different exemplary enzyme cocktails of the invention; as discussed in detail in Example 5, below.
Figure 45:
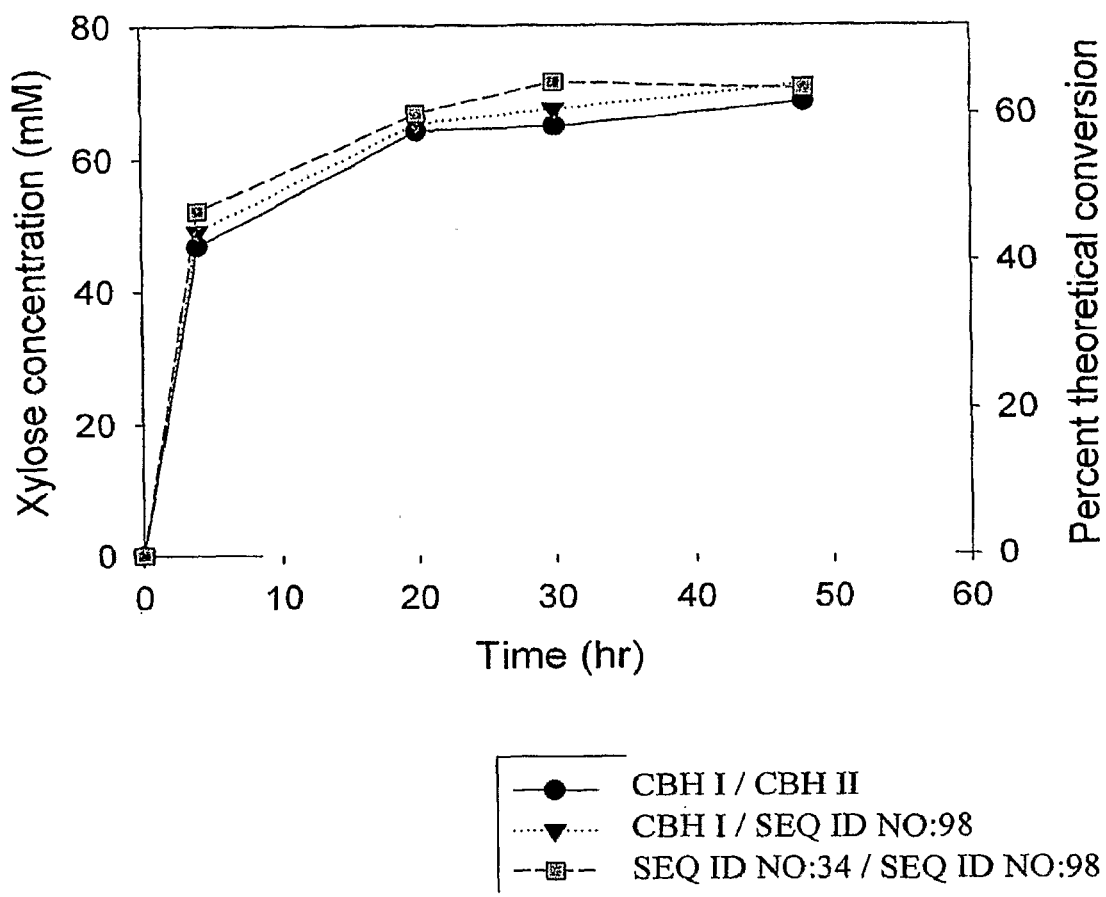

FIGS. 44 and 45 show the time courses of saccharification of Jaygo 2 (5% solids pretreated corn cob) using the three enzyme mixes. While there were some minor differences in rates between the cases all three resulted in almost exactly 80% recovery of glucose and 62% recovery of xylose within 48 hrs. FIG. 44 data demonstrates that glucose release from Jaygo 2 (5% solids) catalyzed by three different exemplary enzyme cocktails of the invention, including: E8 cocktails CBH I/CBH II is Case 1 table; CBH I/SEQ ID NO:98 (encoded by, e.g., SEQ ID NO:97) is Case 2 table and SEQ ID NO:34 (encoded by, e.g., SEQ ID NO:33)/SEQ ID NO:98 (encoded by, e.g., SEQ ID NO:97) is the Case 3 table. Glucose concentration was determined by HPLC analysis of the saccharified liquors sampled at 4, 20, 30 and 48 hrs. Percent conversion was calculated by using 120 mM as 100% available glucose in the pretreated solids. Reaction conditions are pH 5.5 and 50° C. FIG. 45 data demonstrates xylose release from Jaygo 2 (5% solids) catalyzed by these three different exemplary enzyme cocktails of the invention, including: CBH I/CBH II is Case 1 table; CBH I/SEQ ID NO:98 (encoded by, e.g., SEQ ID NO:97) is Case 2 table and SEQ ID NO:34 (encoded by, e.g., SEQ ID NO:33)/SEQ ID NO:98 (encoded by, e.g., SEQ ID NO:97) is the Case 3 table. Xylose concentration was determined by HPLC analysis of the saccharified liquors sampled at 4, 20, 30 and 48 hrs. Percent conversion was calculated by using 113 mM as 100% available xylose in the pretreated solids. Reaction conditions are pH 5.5 and 50° C.

The performance of the exemplary enzyme cocktail "E8" compared to SPEZYME® cellulase is tabulated below:

| Performance Parameters | Benchmark Spezyme ® enzyme* | Diversa Case 1[1] | Diversa Case 2[1] | Diversa Case 3[1] |
|---|---|---|---|---|
| mg active enzyme/g cellulose | 58 | 18.4 | 19.2 | 17.2 |
| Glucose: % Conversion | 75 | 76 | 79 | 76 |
| Glucose: Time for conversion (hr) | 48 | 48 | 48 | 48 |
| Xylose: % Conversion | 59 | 57[2] | 58[2] | 59[2] |
| Xylose: Time for conversion (hr) | 48 | <20 | <20 | <20 |
| % Solids | 5 | 5 | 5 | 5 |

In summary, the exemplary enzyme cocktail "E8" outperformed SPEZYME® cellulase/MULTIFECT® xylanase (rate and extent) with approximately one-third the amount of protein per gram (protein/g) cellulose.

Exemplary Enzymes—Higher Solids Saccharification

Figure 46:
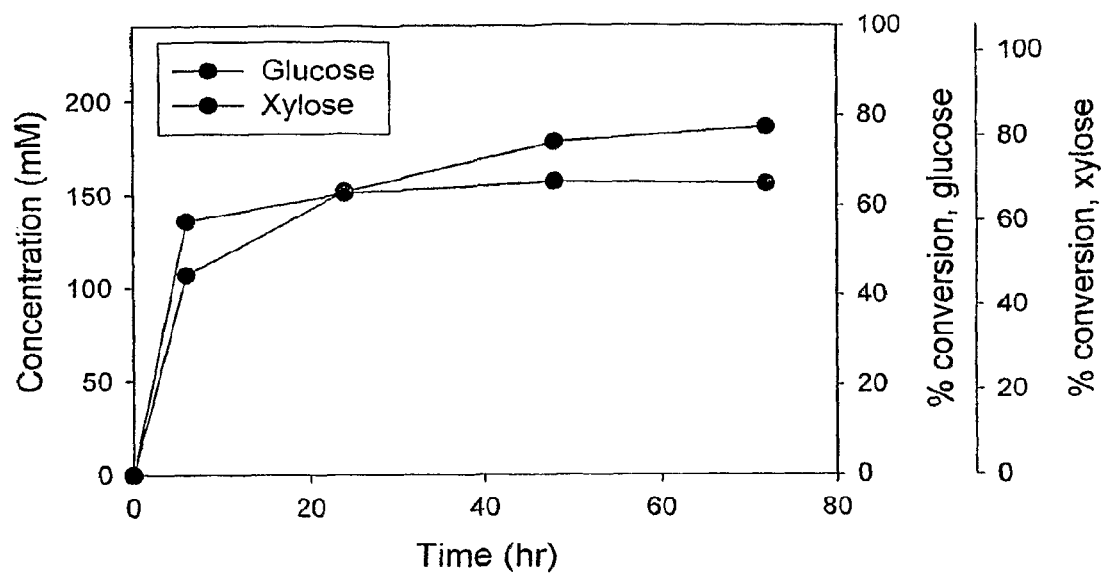
FIG. 46 graphically illustrates data demonstrating the digestion of a 10% cellulose solids composition using 58 mg of the exemplary "E9 cocktail" per gram cellulose; as discussed in detail in Example 5, below.

Ultimately a biomass process will require solids loadings higher than 5% with low enzyme content. Therefore we set out to evaluate the performance of the Diversa cocktails at 10% solids and then reduce the amount of protein in the cocktails from 20 mg/g cellulose to approximately 12 mg/g cellulose. Initial experiments were performed at enzyme loadings similar to the standard SPEZYME® cellulase/ MULTIFECT® xylanase mixtures (58 mg protein/g cellulose). These data are shown in FIG. 46. Under these reaction conditions the exemplary E9 cocktail reached 74% and 70% conversion for glucose and xylose, respectively. FIG. 46 data demonstrates the digestion of Jaygo 2 (10% solids pretreated corn cob) using 58 mg "E9 cocktail"/g cellulose. Percent conversion was based on 240 mM glucose and 226 mM xylose as 100%; and the following table summarizes the performance characteristics of an exemplary E9 cocktail at 58 mg/g cellulose loading and 10% solids:

| Performance Parameters | exemplary E9 cocktail |
|---|---|
| mg active enzyme/g cellulose | 58 |
| Glucose: % Conversion | 74 |
| Glucose: Time for conversion (hr) | 48 |
| Xylose: % Conversion | 71 |
| Xylose: Time for conversion (hr) | 48 |
| % Solids | 10 |

The next goal was to decrease protein dosage to approximately 12 mg/g cellulose. Four different recipes for the exemplary enzyme mixture called E8 (the "E8 cocktails") were used, altering the hemicellulase and cellulase ratios. The table below details the recipes of the four exemplary cocktails and the amount of xylose and glucose released at 36 hrs. This table summarizes data showing the performance of four different exemplary "E8 cocktails" on 10% Jaygo 2 (10% solids pretreated corn cob):

| Conv % | G1 - 36 hr | X1 - 36 hr | G1 - 48 hr | X1 - 48 hr | mg/g cellulose |
|---|---|---|---|---|---|
| 1xE, CBH1(0.25)/SEQ ID NO: 100(0.75) | 46.7 | 61.3 | 49.7 | 60.7 | 11.9 |
| 1xE, CBH1(0.24)/SEQ ID NO: 100(1) | 42.2 | 60.4 | 46.7 | 60.6 | 12 |
| 1xE, CBH1(0.24)/SEQ ID NO: 98(0.1)/SEQ ID NO: 100(1) | 50.1 | 61.4 | 52.0 | 60.2 | 12 |
| 1xE, SEQ ID NO: 34(0.75)/SEQ ID NO: 98(0.1)/SEQ ID NO: 100(1) | 50.5 | 61.5 | 54.7 | 61.9 | 12 |

Cellulose hydrolysis appeared to be sensitive to both the cellulase and hemicellulase concentrations (a synergy between the enzyme types) whereas hemicellulose hydrolysis (as measured by xylose release) appeared to be sensitive only to hemicellulase content. Under these conditions xylose conversion is maintained at about 60% at 36 hrs while glucose conversion drops to approximately 50% as compared to performance at a higher enzyme loading.

A systematic study was undertaken in order to clarify the interplay between biomass solids content and enzyme loading. Reactions were set up with 18 mg protein/g cellulose and 9 mg protein/g cellulose at 1%, 5% and 10% Jaygo 2 (pretreated corn cob).

Time courses for glucose, expressed in percent conversion and concentration, are shown in FIGS. 47 to 50, and time courses for xylose (also expressed in percent conversion and concentration) are shown in FIGS. 51 to 54. Though more sugar is released at the higher solids loading, the percent conversion decreases. Clearly glucose release was much more sensitive to solids loading than xylose, as a matter of fact at the high enzyme load (18 mg/g) there was almost no difference in xylose yield between the different percent solids in the reactor. Possible explanations for the decrease in performance as substrate concentration increases are (1) product inhibition by glucose, xylose, cellobiose or xylobiose (2) mass transfer (mixing) deficiencies or (3) a combination of both.

Figure 47:
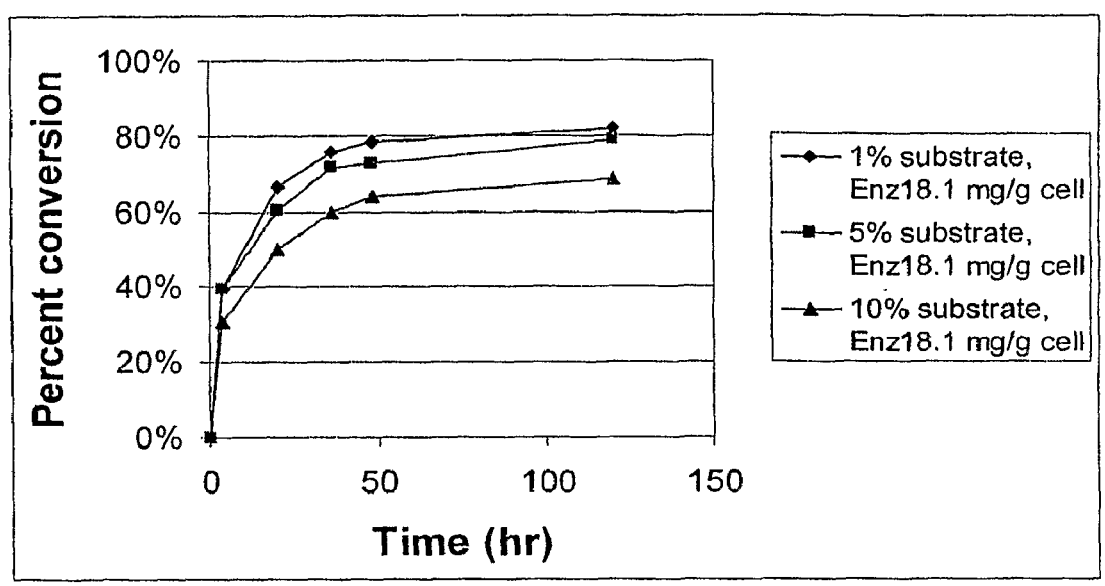
FIG. 47 graphically illustrates data demonstrating the time courses for glucose appearance using 18.1 mg of the exemplary enzyme cocktail "E8" per gram cellulose and 1, 5 and 10% solids—pretreated corn cob; as discussed in detail in Example 5, below.
Figure 48:
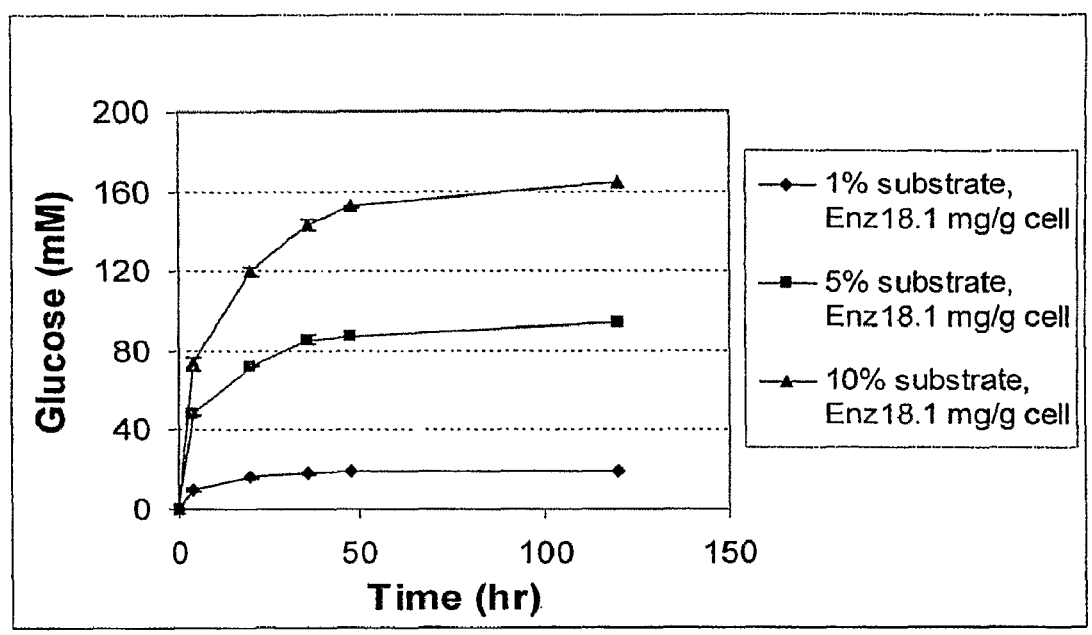
FIG. 48 graphically illustrates data demonstrating time courses for glucose appearance using 18.1 mg of the exemplary E8 enzyme cocktail/g cellulose and 1, 5 and 10% solids—pretreated corn cob; as discussed in detail in Example 5, below.
Figure 49:
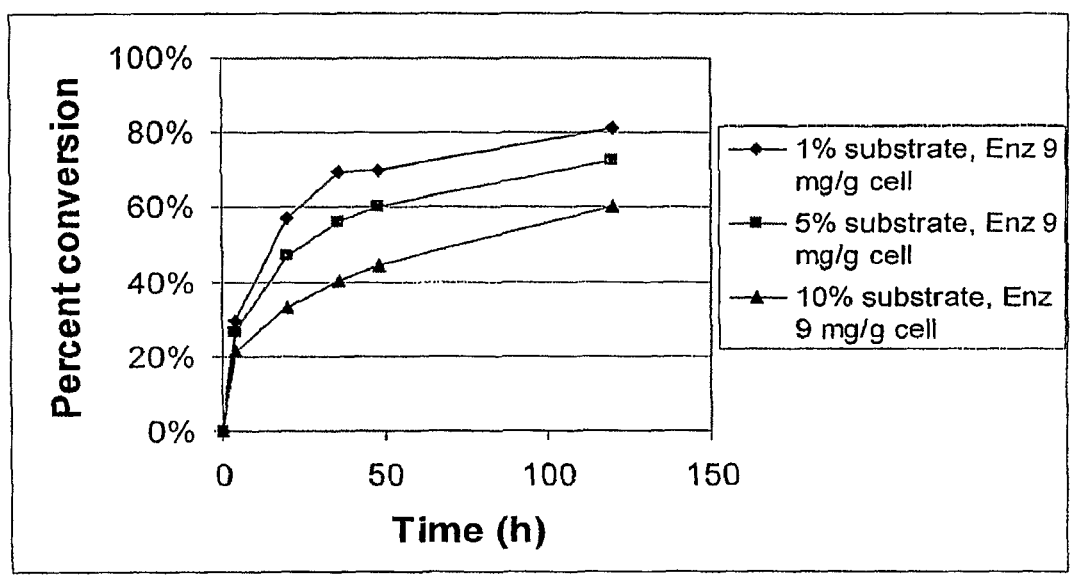
FIG. 49 graphically illustrates data demonstrating time courses for glucose appearance using 9 mg of the exemplary E8 enzyme cocktail/g cellulose and 1, 5 and 10% solids—pretreated corn cob; as discussed in detail in Example 5, below.
Figure 50:
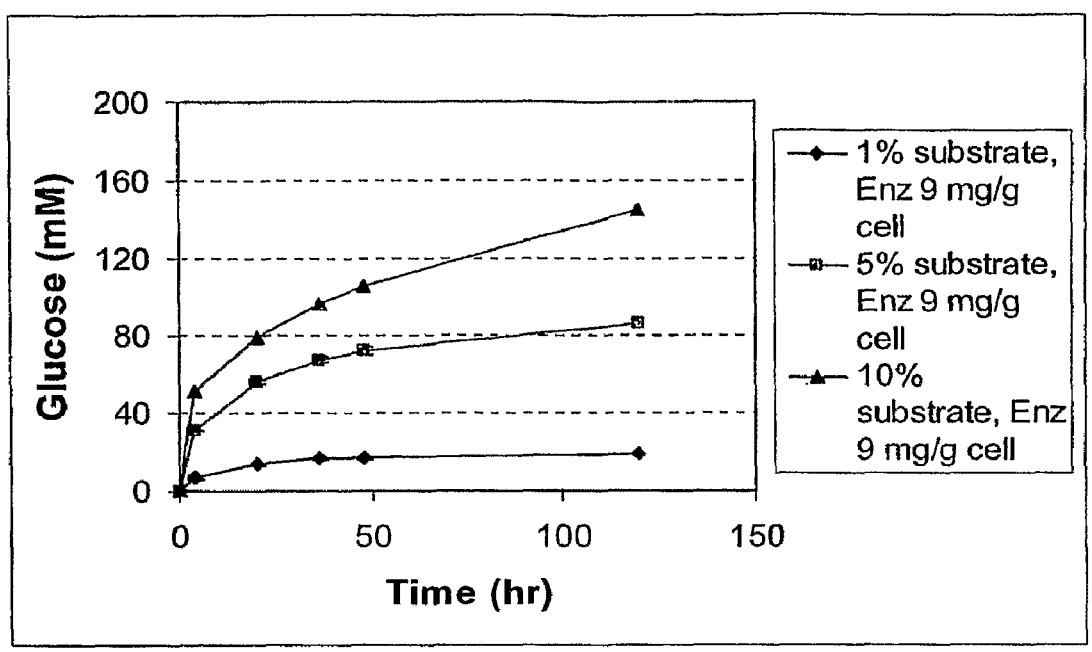
FIG. 50 graphically illustrates data demonstrating time courses for glucose appearance using 9 mg of the exemplary E8 enzyme cocktail/g cellulose and 1, 5 and 10% solids (pretreated corn cob); as discussed in detail in Example 5, below.
Figure 51:
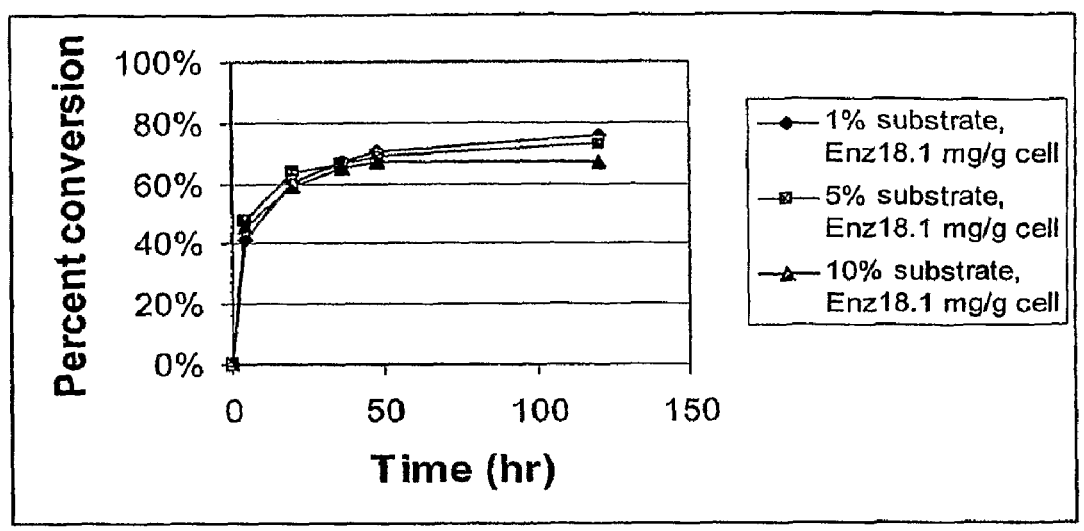
FIG. 51 graphically illustrates data demonstrating time courses for xylose appearance using 18 mg of the exemplary E8 enzyme cocktail/g cellulose and 1, 5 and 10% solids pretreated corn cob; as discussed in detail in Example 5, below.
Figure 52:
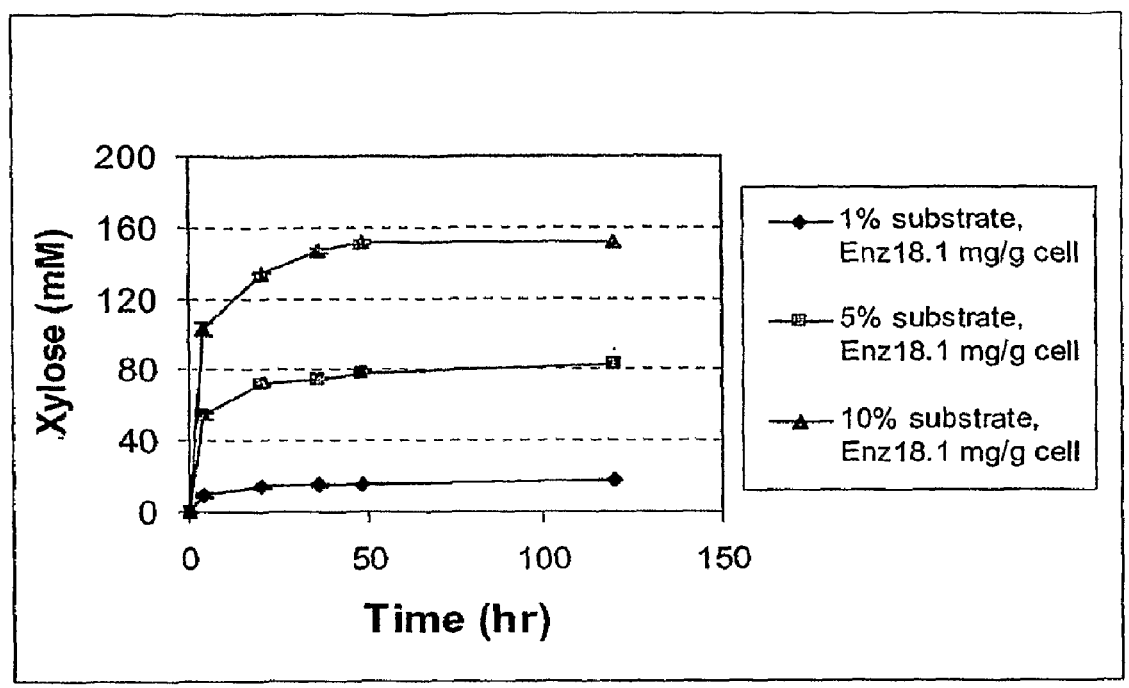
FIG. 52 graphically illustrates data demonstrating time courses for xylose appearance using 18 mg of the exemplary E8 enzyme cocktail/g cellulose and 1, 5 and 10% solids pretreated corn cob; as discussed in detail in Example 5, below.
Figure 53:
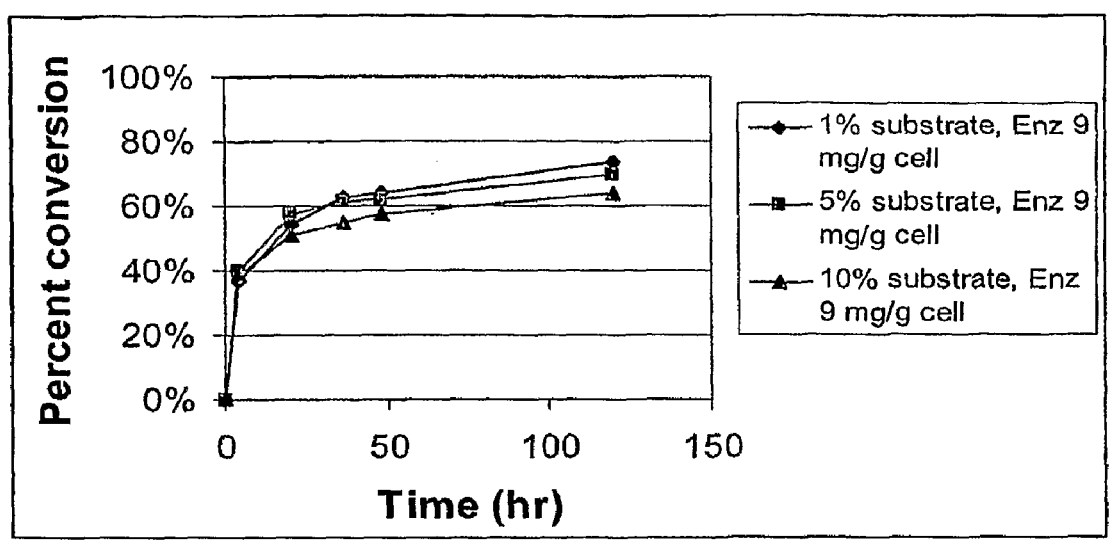
FIG. 53 graphically illustrates data demonstrating time courses for xylose appearance using 9 mg of the exemplary E8 enzyme cocktail/g cellulose and 1, 5 and 10% solids pretreated corn cob; as discussed in detail in Example 5, below.
Figure 54:
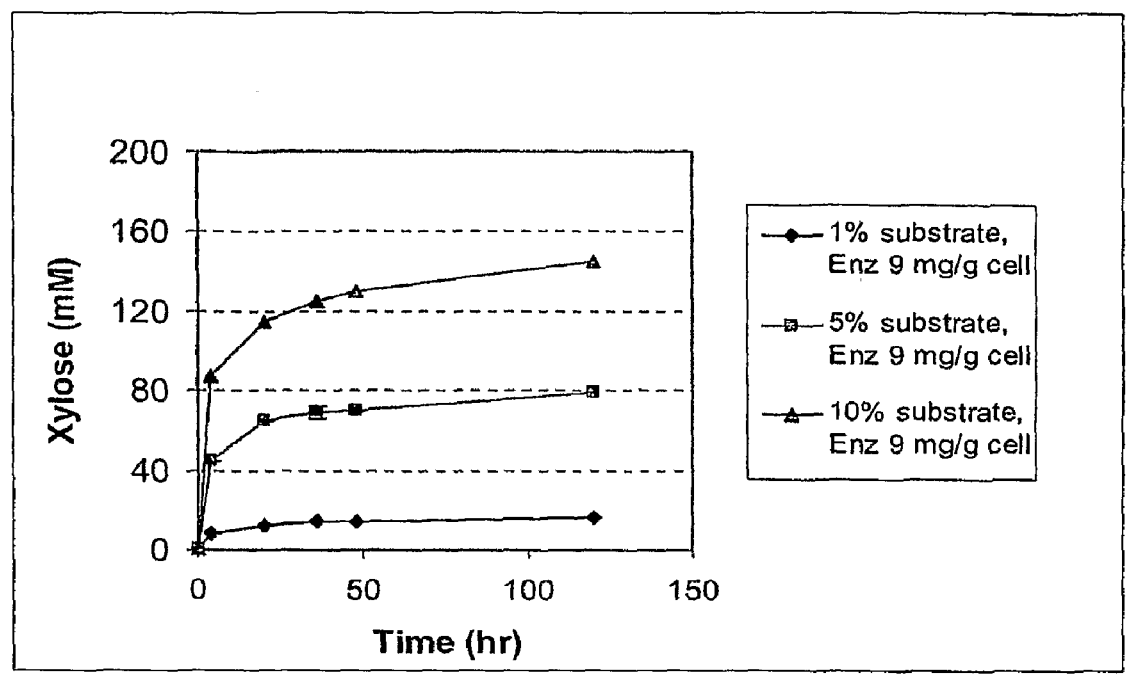
FIG. 54 graphically illustrates data demonstrating time courses for xylose appearance using 9 mg of the exemplary E8 enzyme cocktail/g cellulose and 1, 5 and 10% solids pretreated corn cob; as discussed in detail in Example 5, below.
Figure 55:
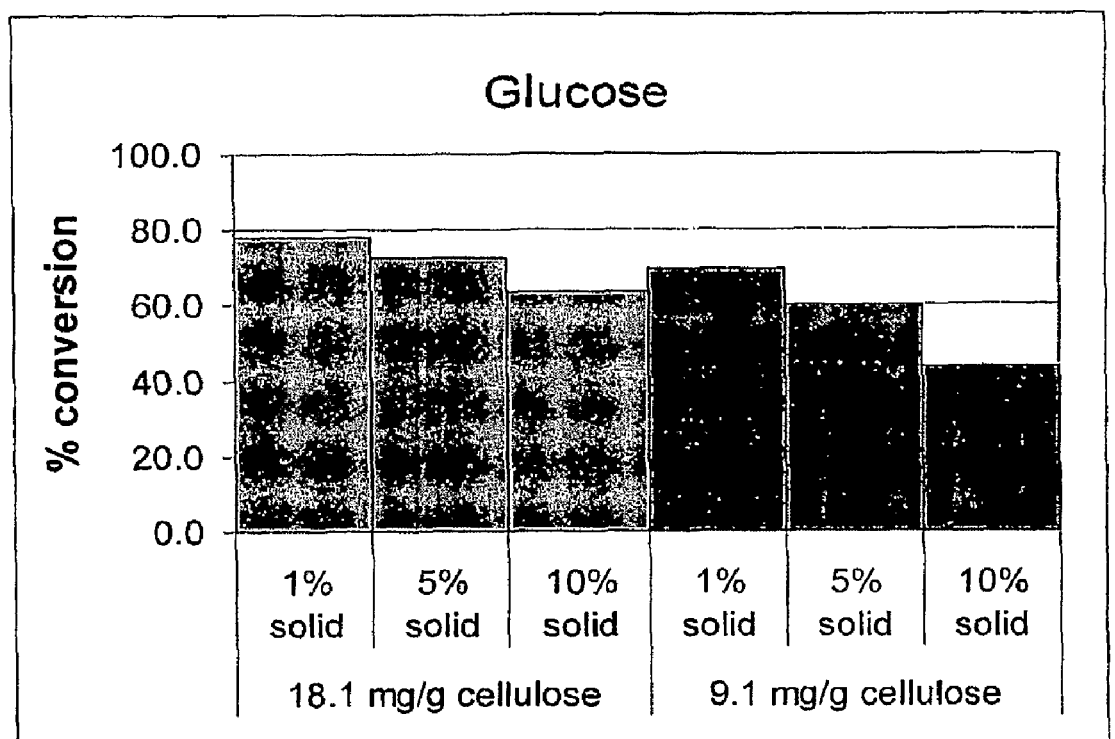
FIGS. 55 and 56 in chart form summarize the data shown in FIGS. 47 to 50 (glucose) and FIGS. 51 to 54 (xylose); as discussed in detail in Example 5, below.
Figure 56:
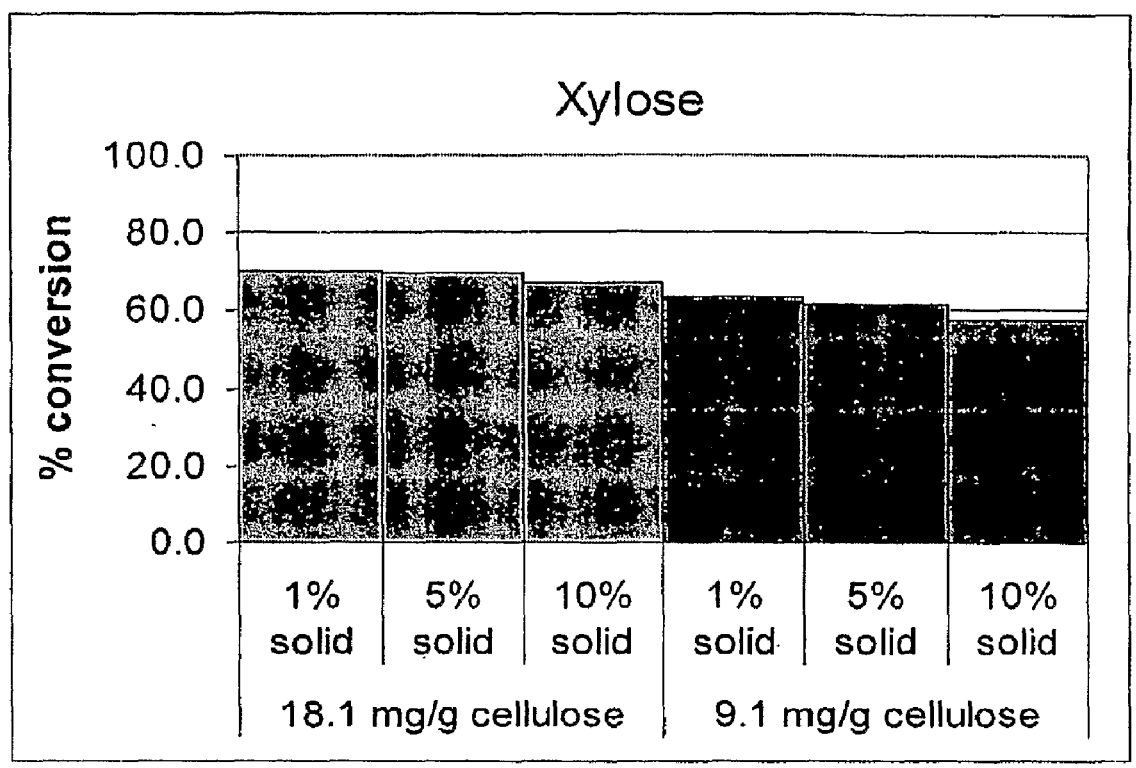

FIG. 47 data illustrates the time courses for glucose appearance using 18.1 mg of the exemplary enzyme cocktail "E8" per gram cellulose (18.1 mg E8 mix/g cellulose) and 1, 5 and 10% solids (Jaygo 2) (pretreated corn cob). Percent conversion was based on theoretical glucose yields of 240 mM, 120 mM and 24 mM for 10%, 5% and 1% solids, respectively. FIG. 48 data illustrates time courses for glucose appearance using 18.1 mg of the exemplary E8 enzyme cocktail/g cellulose and 1, 5 and 10% solids (Jaygo 2) (pretreated corn cob). FIG. 49 data illustrates time courses for glucose appearance using 9 mg of the exemplary E8 enzyme cocktail/g cellulose and 1, 5 and 10% solids (Jaygo 2) (pretreated corn cob). Percent conversion was based on theoretical glucose yields of 240 mM, 120 mM and 24 mM for 10%, 5% and 1% solids, respectively. FIG. 50 data illustrates time courses for glucose appearance using 9 mg of the exemplary E8 enzyme cocktail/g cellulose and 1, 5 and 10% solids (Jaygo 2) (pretreated corn cob). FIG. 51 data illustrates time courses for xylose appearance using 18 mg of the exemplary E8 enzyme cocktail/g cellulose and 1, 5 and 10% solids (Jaygo 2) (pretreated corn cob). Percent conversion was based on theoretical glucose yields of 226 mM, 113 mM and 23 mM for 10%, 5% and 1% solids, respectively. FIG. 52 data illustrates time courses for xylose appearance using 18 mg of the exemplary E8 enzyme cocktail/g cellulose and 1, 5 and 10% solids (Jaygo 2) (pretreated corn cob). FIG. 53 data illustrates time courses for xylose appearance using 9 mg of the exemplary E8 enzyme cocktail/g cellulose and 1, 5 and 10% solids (Jaygo 2) (pretreated corn cob). Percent conversion was based on theoretical glucose yields of 226 mM, 113 mM and 23 mM for 10%, 5% and 1% solids, respectively. FIG. 54 data illustrates time courses for xylose appearance using 9 mg of the exemplary E8 enzyme cocktail/g cellulose and 1, 5 and 10% solids (Jaygo 2) (pretreated corn cob). FIGS. 55 and 56 in chart form summarize the data shown in FIGS. 47 to 50 (glucose) and FIGS. 51 to 54 (xylose). For FIG. 55: percent glucose conversion at 48 hrs using different enzyme (the exemplary E8 enzyme cocktail) and solids (Jaygo 2) loadings; FIG. 56: Percent xylose conversion at 48 hrs using different enzyme (the exemplary E8 enzyme cocktail) and solids (Jaygo 2) loadings. These data are summarized in the table, below:

Summary table performance parameters

| Performance parameters | Benchmark | Measured Benchmark* | Exemplary E8 cocktail | Exemplary E9 cocktail |
|---|---|---|---|---|
| mg active enzyme/g cellulose | 20 | 58 (15 FPU) | 12 | 58 |
| Glucose: % conversion | 80 | 73 | 50 | 74 |
| Glucose: Conversion time (h) | 48 | 48 | 36 | 48 |
| Xylose: % conversion | 65 | 57 | 62 | 70 |
| Xylose: Conversion time (h) | 48 | 48 | 36 | 48 |
| % solids | 2.5 | 10 | 10 | 10 |

*7.5 FPU SPEZYME ® cellulase plus 7.5 "FPU equivalents" MULTIFECT ® xylanase

Example 6

Characterization of the Activity of Enzymes of the Invention

This example describes characterizes exemplary enzymes of the invention. For example, this example describes how exemplary enzymes of the invention can be used as cellulolytic enzymes for the hydrolysis of biomass, e.g., plant biomass, such as pretreated corn stover. In one aspect, exemplary enzymes of the invention are used alone or in combination as endoglucanases, cellobiohydrolases and/or β-glucosidases for, e.g., the treatment, e.g. saccharification, of cellulose or cellulose-comprising compositions, such as plant biomass, e.g., pretreated stover or fiber.

In this example, forty-five (45) enzymes of the invention are characterized: 16 are classified as β-glucosidases, 5 are endoglucanases and 24 are cellobiohydrolases. These enzymes alone or in combination can be used in the hydrolysis of cellulose in biomass, e.g., plant biomass, such as pretreated corn stover/fiber. Exemplary enzymes of the invention are listed in the table below, wherein the odd SEQ ID NOs: are nucleotide sequences and the even SEQ ID NOs: are amino acid sequences; for example, to aid in reading the table, SEQ ID NO:2, encoded by, e.g., SEQ ID NO:1, has cellobiohydrolase activity; SEQ ID NO:4, encoded by, e.g., SEQ ID NO:3, has β-glucosidase activity, etc:

| SEQ ID NO: | Activity Class |
|---|---|
| 1, 2 | Cellobiohydrolase |
| 3, 4 | B-glucosidase |
| 5, 6 | B-glucosidase |
| 7, 8 | B-glucosidase |
| 9, 10 | Cellobiohydrolase |
| 11, 12 | Cellobiohydrolase |
| 13, 14 | B-glucosidase |
| 15, 16 | B-glucosidase |
| 17, 18 | B-glucosidase |
| 19, 20 | Cellobiohydrolase |
| 21, 22 | Cellobiohydrolase |
| 23, 24 | B-glucosidase |
| 25, 26 | Cellobiohydrolase |
| 27, 28 | Cellobiohydrolase |
| 29, 30 | B-glucosidase |
| 31, 32 | B-glucosidase |
| 33, 34 | Cellobiohydrolase |
| 35, 36 | Cellobiohydrolase |
| 37, 38 | Endoglucanase |
| 39, 40 | Endoglucanase |
| 41, 42 | B-glucosidase |
| 43, 44 | Cellobiohydrolase |
| 45, 46 | Cellobiohydrolase |
| 47, 48 | Eudoglucanase |
| 49, 50 | B-glucosidase |
| 51, 52 | Cellobiohydrolase |
| 53, 54 | Cellobiohydrolase |
| 55, 56 | Cellobiohydrolase |
| 57, 58 | B-glucosidase |
| 59, 60 | Cellobiohydrolase |
| 61, 62 | Endoglucanase |
| 63, 64 | Cellobiohydrolase |
| 65, 66 | Cellobiohydrolase |
| 67, 68 | Cellobiohydrolase |
| 69, 70 | B-glucosidase |
| 71, 72 | Cellobiohydrolase |
| 73, 74 | Cellobiohydrolase |
| 75, 76 | B-glucosidase |
| 77, 78 | Cellobiohydrolase |
| 79, 80 | B-glucosidase |
| 81, 82 | Cellobiohydrolase |
| 83, 84 | Cellobiohydrolase |
| 85, 86 | Endoglucanase |
| 87, 88 | Cellobiohydrolase |
| 89, 90 | B-glucosidase |

The invention also provides for the manipulation and/or modification of the sequences of the invention, including the exemplary sequences noted above. One of skill in the art would recognize that such modification can occur at one or more base pairs, codons, introns, exons, or amino acid residues, yet still retain the biological (e.g., enzymatic, or substrate binding) activity of the enzyme of the invention.

Variants of the polypeptide sequences of the invention may include one or more amino acid substitutions, e.g. with a conserved or non-conserved amino acid residue. In one aspect, substituted amino acid residues may or may not be one encoded by the genetic code. In one aspect, variants comprising one or more amino acid residues of the polypeptides of the invention comprise a substituent group or substituent groups. Still other variants substituents of the invention comprise polypeptides associated with another compound (e.g., a mixture, heteroconjugate or heterodimer, etc.), such as a compound to increase the half-life of the polypeptide (for example, polyethylene glycol). Additional embodiments comprising enzymes of the invention are those in which additional amino acids are fused to the enzyme, or joined as a heteroconjugate recombinant protein, where the heterologous sequence comprises, e.g., non-enzymatic sequence. The joined or fused additional amino acids can comprise a leader sequence or a secretory sequence, a proprotein sequence or a sequence which facilitates purification, enrichment, or stabilization of the polypeptide. Methods of making variants are familiar to those skilled in the art.

In another aspect, enzymes of the invention have additional or different enzymatic activities from those noted above. For example, in one aspect, an enzyme of the invention having β-glucosidase activity also can have β-mannosidase, or another, activity. In another aspect, an enzyme of the invention having endoglucanase activity can have exoglucanase activity or another activity.

Example 7

Xylanase for Enhancing Digestion of Cellulose in Lignocellulosic Biomass

This example describes and characterizes an exemplary enzyme of the invention having xylanase activity that enhances the digestion of cellulose in a lignocellulosic biomass; in particular, a plant biomass comprising corn stover.

This example describes studies demonstrating the enhancement of cellulase action on biomass samples containing both cellulose and hemicellulose when a xylanase is present in the reaction mixture. In one aspect, the xylanase itself has no cellulase activity but enhances cellulolytic activity, e.g., in one aspect, by removing interfering hemicellulose to reveal additional reactive sites on the cellulose. Though the xylanase used here is the exemplary enzyme of the invention SEQ ID NO:444 (encoded by, e.g., SEQ ID NO:443), any xylanase or hemicellulase can be used to practice the compositions and methods of the invention.

The substrate used in these studies comprised an alkaline pretreated corn stover (alkPCS) sample. Specifically this corn stover sample was treated with $NH_4OH$ (5% or 15%) at 140° C. or 170° C. "High", "low" and "medium" severity refers to the conditions of pretreatment. High severity conditions were 15% $NH_4OH$, 170° C. for 5 minutes; low severity was 5% $NH_4OH$ and 140° C. and medium severity was at 15% $NH_4OH$ and 140° C. The solids composition of the high severity alkPCS was determined and is shown in Table 1:

TABLE 1

| Composition of high severity alkPCS. | |
|---|---|
| Component | Weight percent |
| Protein | 3 |
| Ash | 4.7 |
| Lignin | 11.4 |
| Glucan | 45.7 |
| Xylan | 26.6 |
| Galactan | 0.9 |
| Arabinan | 3.1 |
| Mannan | 2 |
| Uronic acids | |
| Acetyl | |
| Total | 97.4 |

Figure 17:
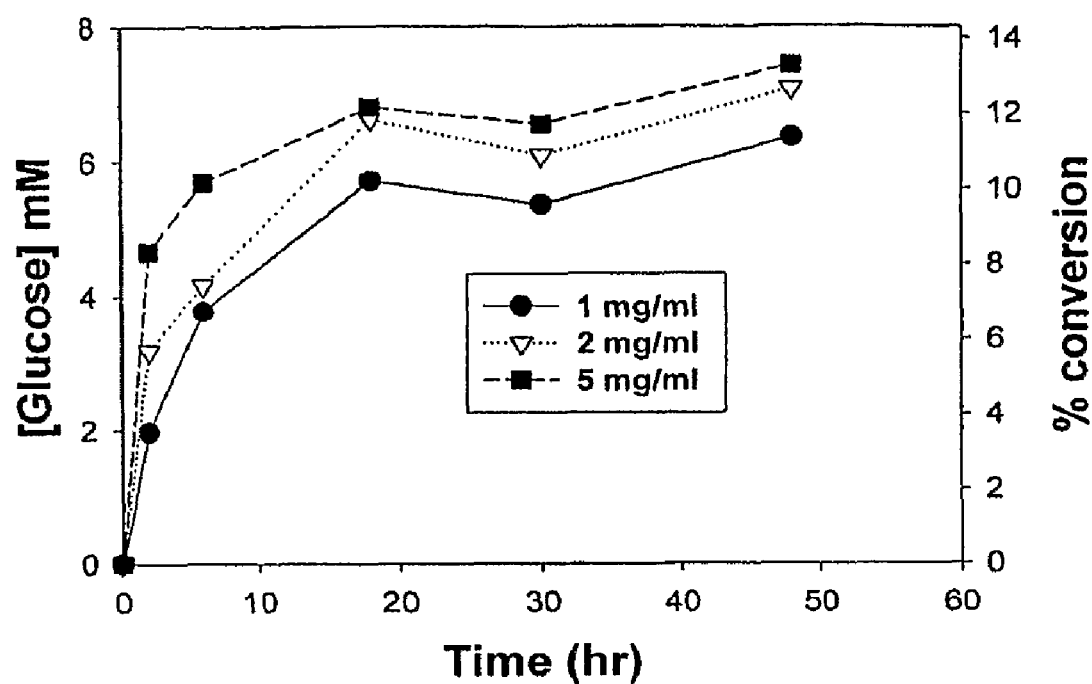
FIG. 17 illustrates data from the digestion of alkaline pretreated corn stover using 3 different concentrations of an exemplary endoglucanase of the invention; product release (cellobiose and glucose) was monitored over time using an HPLC method, as discussed in detail in Example 7, below.

Digestion of this material (2.2% solids) was carried out using 3 different concentrations of the endoglucanase SEQ ID NO:106 (encoded by, e.g., SEQ ID NO:105) (in crude *E. coli* lysate) at pH 5 and 50° C. Product release (cellobiose and glucose) was monitored over time (data summarized and illustrated in FIG. 17) using an HPLC method. Observed cellobiose was converted into "glucose equivalents" prior to plotting the data. 100% conversion of all the glucan would result in approximately 56 mM glucose. FIG. 17 illustrates data showing the glucose release from high severity alkPCS due to the enzymatic activity of the exemplary endoglucanase of the invention SEQ ID NO:106 (encoded by, e.g., SEQ ID NO:105).

Figure 18:
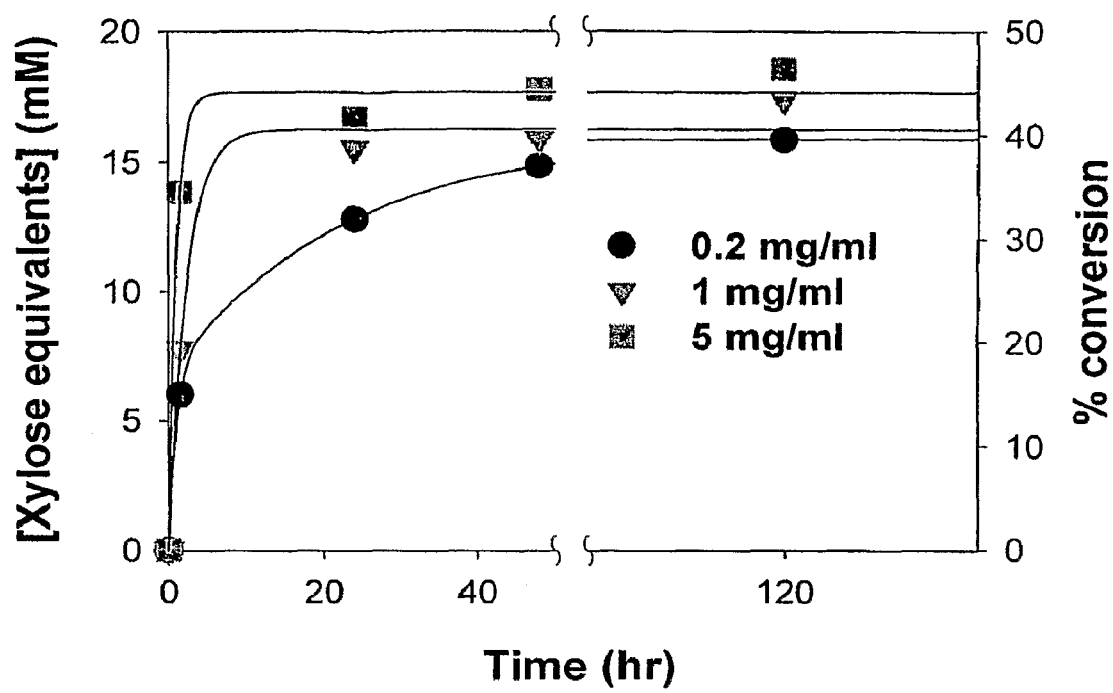
FIG. 18 illustrates data demonstrating xylose release from high severity alkaline pretreated corn stover (alkPCS) by the exemplary xylanase of the invention as discussed in detail in Example 7, below.

The rate of glucose appearance was enzyme-concentration dependent, however the extent of hydrolysis seemed to reach a maximum of between 10-14%. Similar results were obtained using the exemplary xylanase SEQ ID NO:444 (encoded by, e.g., SEQ ID NO:443) (as illustrated in FIG. 18), except that xylose and xylobiose were released and the extent of digestion was between 40% and 50% (complete conversion would release approx. 40 mM of xylose). The exemplary xylanase SEQ ID NO:444 (encoded by, e.g., SEQ ID NO:443) did not release any glucose, either monomer or cellobiose. FIG. 18 illustrates in graphic form data demonstrating xylose release from high severity alkaline pretreated corn stover (alkPCS) by the exemplary xylanase SEQ ID NO:444 (encoded by, e.g., SEQ ID NO:443).

Figure 19:
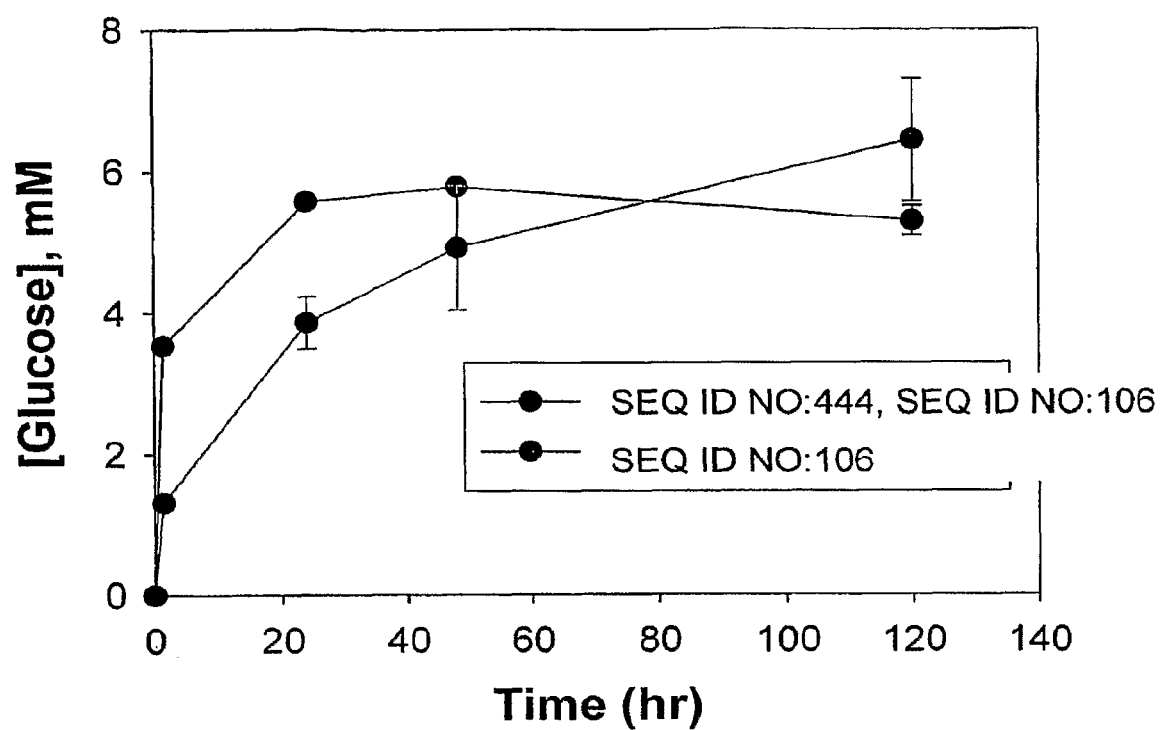
FIG. 19 illustrates data demonstrating digestion of high severity alkaline pretreated corn stover (alkPCS) by exemplary enzymes of the invention, as discussed in detail in Example 7, below.

The combination of the exemplary SEQ ID NO:106 (encoded by, e.g., SEQ ID NO:105) and SEQ ID NO:444 (encoded by, e.g., SEQ ID NO:443) resulted in a substantial increase in the rate of glucose release, reaching maximum conversion at a much shorter time, however no increase in extent was observed, as illustrated in FIG. 19. There was no improvement in the rate of xylose release by the addition of the endoglucanase. FIG. 19 illustrates in graphic form data demonstrating digestion of high severity alkPCS by the exemplary SEQ ID NO:106 (encoded by, e.g., SEQ ID NO:105) and by the exemplary SEQ ID NO:444 (encoded by, e.g., SEQ ID NO:443) and SEQ ID NO:106 (encoded by, e.g., SEQ ID NO:105). Each enzyme was added to 1 mg/ml total protein and the digestion occurred at pH 5 and 50° C. using 2.2% solids.

Figure 20A:
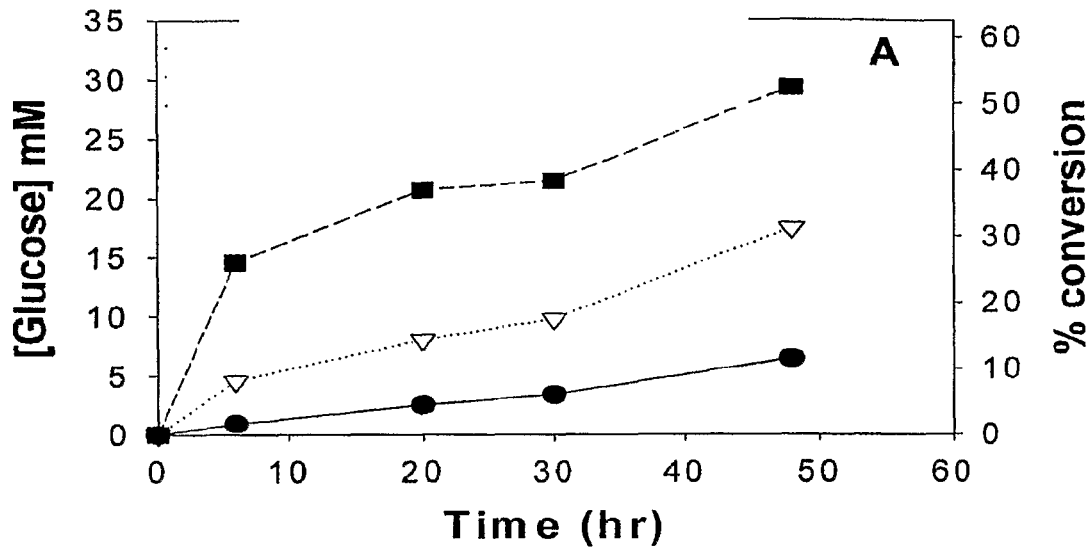
FIG. 20 illustrates data showing both rate and extent of glucose release using combinations of cellobiohydrolase I (CBH I) (FIG. 20A) and cellobiohydrolase II (CBH II) (FIG. 20B) with an exemplary xylanase and an exemplary endoglucanase, as discussed in detail in Example 7, below.
Figure 20B:
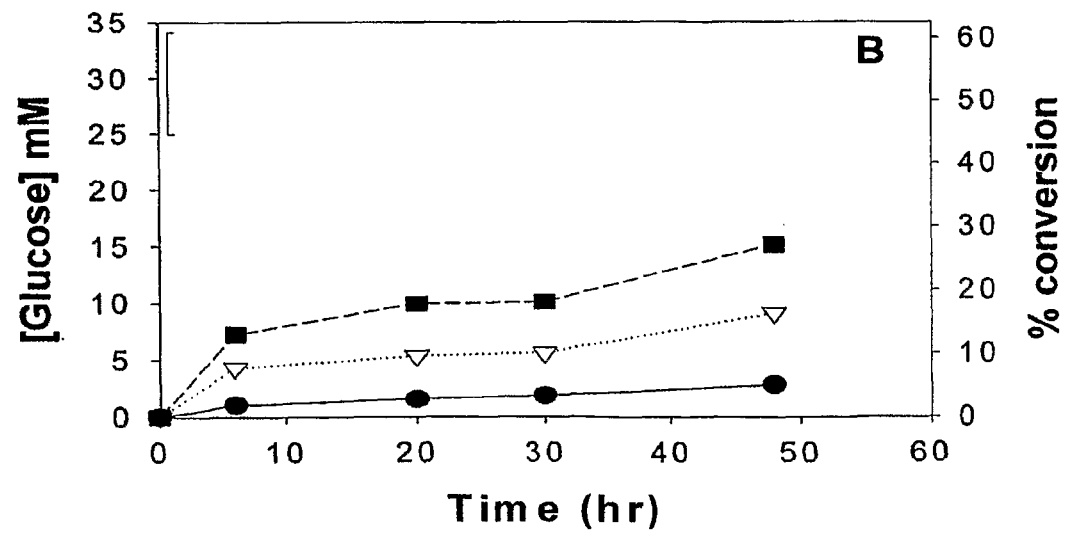

Partial digestion of high severity alkaline pretreated corn stover (alkPCS) is also observed when cellobiohydrolase (CBH) is used, as demonstrated by data illustrated in FIGS. 20A and 20B. Purified CBH I and CBH II from *Trichoderma reesei* were purchased from Megazyme (Co. Wicklow, Ireland) and added to a final concentration of 0.05 mg/ml containing 2.2% alkPCS (pH 5 and 50° C.). The exemplary β-glucosidase SEQ ID NO:264 (encoded by, e.g., SEQ ID NO:263) was also added to convert cellobiose to glucose. When the exemplary xylanase SEQ ID NO:444 (encoded by, e.g., SEQ ID NO:443), 0.4 mg/ml is added to the reaction mix a significant enhancement is observed in both rate and extent of glucose release, see FIGS. 20A and 20B. Furthermore, when the exemplary endoglucanase SEQ ID NO:106 (encoded by, e.g., SEQ ID NO:105) (1 mg/ml) is included there is an additional increase in the amount of glucose released reaching conversion levels of close to 55% for the CBH I combination and 30% for the CBH II combination. FIG. 20 illustrates data showing both rate and extent of glucose release using combinations of CBH I (A) and CBH II (B) with the exemplary xylanase SEQ ID NO:444 (encoded by, e.g., SEQ ID NO:443) and the exemplary endoglucanase SEQ ID NO:106 (encoded by, e.g., SEQ ID NO:105).

Example 8

Degradation of Cellulosic Materials with Thermostable Endoglucanases

This example describes the discovery of and characterization of the activity of thermostable endoglucanases (EGs) of the invention.

In some aspects, endoglucanases of the invention, and enzymes used to practice the methods of the invention, are capable of digesting (e.g., hydrolyzing) crystalline cellulose under conditions comprising anywhere in the range of between about 60° C. to 80° C. In some aspects, endoglucanases of the invention are useful in high temperature biomass saccharification processes coupled with fermentation to ethanol. In some aspects, carrying out these biomass saccharification processes at elevated temperatures is advantageous due to increased reaction rates that occur as the temperature is raised. Hydrolysis of crystalline cellulose is important since this material typically presents a challenge to enzymatic digestion due to its highly ordered and stable structure. In addition, crystalline cellulose constitutes a large percentage of the cellulose in lignocellulosic materials that are used in a biomass to ethanol process of the invention.

This example describes methods used to identify thermostable EGs of the invention that possess high hydrolytic activity on cellulosic materials at elevated temperatures. Thermostable endoglucanases were tested for activity using microcrystalline cellulose AVICEL® (MCC) because MCC is 50% to 60% crystalline; thus, performance on MCC would be predictive of performance on pretreated corn stover (PCS). There is literature evidence that this is true for dilute acid PCS. Although the final process may not demand thermostable enzymes, a high temperature saccharification may have improved rates of hydrolysis, therefore decreasing enzyme loading and/or residence time requirements.

In one aspect, this method applies to protein mixtures that contain an endoglucanase (e.g., clear cell lysates). The specific activity of EGs on soluble cellulose substrate carboxylmethyl cellulose (CMC), termed as CMCase activity (μmol $min^{-1}$ per mg of protein), is determined at 37° C., pH 7.0; and the data is summarized in the table illustrated in FIG. 28. The hydrolytic activity of EGs on microcrystalline cellulose AVICEL® (MCC), termed "Avicelase activity" at mM reducing sugar released per mg of protein in 24 h, is also determined at various temperatures (e.g. 37° C., 60° C. and 80° C.), and pHs (e.g. pH 5, pH 7 and pH 9). EGs with high "Avicelase activity" at elevated temperatures (e.g. >60° C.) are identified. The ratio of Avicelase activity vs. CMCase units used in the reactions is calculated and used to further identify EGs that possess high specific Avicelase activity.

Exemplary endoglucanases were assayed for their specific activity on CMC and their CMCase activity was obtained. These enzymes were also used to hydrolyze AVICEL® at 37, 60 and 80° C., and pH 5, 7 and 9. In these assays, 1% of AVICEL® and 1 mg $mL^{-1}$ of EG-containing cell lysates were used. The products released (in mM) after 24 h incubation were measured using reducing sugar assay, the BCA assay. A commercially available enzyme (*Trichoderma longibrachiatum* EG from Megazyme International, Ireland) was used as a benchmark for comparison. A total of twelve EGs exhibited high AVICEL® hydrolytic activity at 60° C. or above. Among them, the exemplary enzymes SEQ ID NO:318 (encoded by, e.g., SEQ ID NO:317), 9963, 10061, and SEQ ID NO:314 (encoded by SEQ ID NO:313) had greater Avicelase/CMCase ratio than the benchmark EG.

In one aspect, methods comparing thermostable EGs under conditions in which amount of enzymes in the reactions is normalized. The thermostable EGs identified from the above-described methods can be further compared for their hydrolytic activity on cellulosic materials when same number of CMCase units is used in the assays.

Figure 29A:
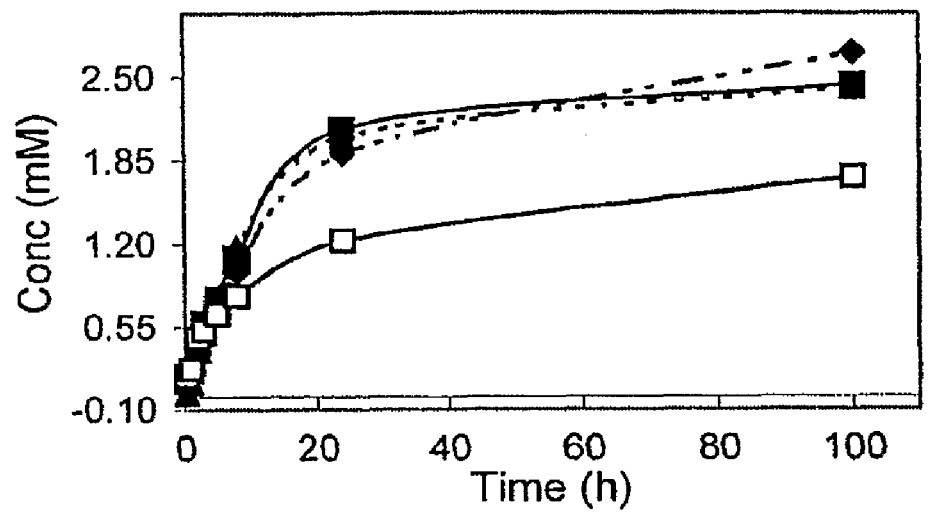
(FIG. 29A) and 80° C.
Figure 29B:
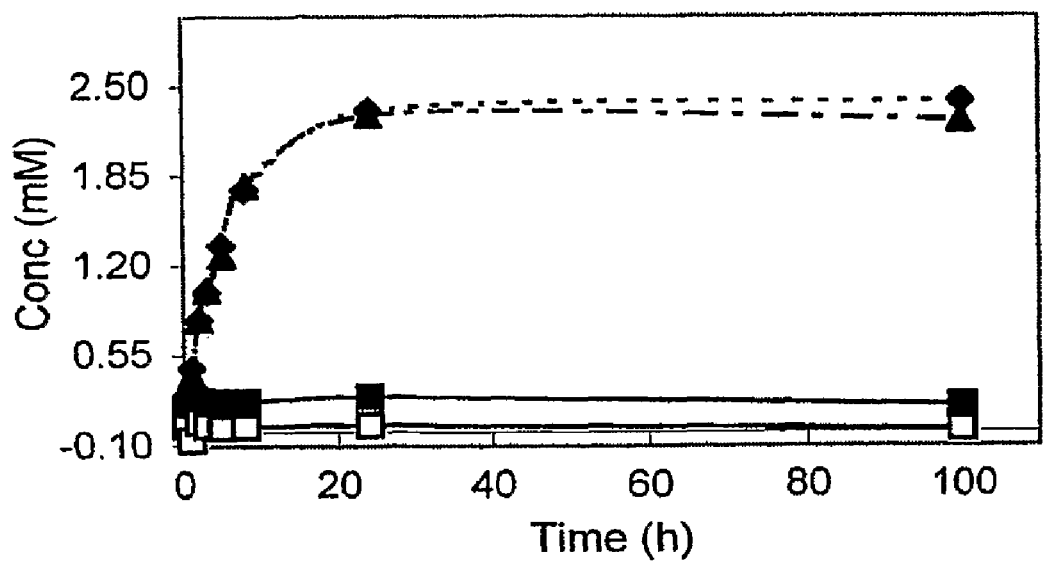
(FIG. 29B); as discussed in detail in Example 8, below.

For example, the exemplary enzymes EGs SEQ ID NO:318 (encoded by, e.g., SEQ ID NO:317), SEQ ID NO:308 (encoded by, e.g., SEQ ID NO:307) and SEQ ID NO:314 (encoded by, e.g., SEQ ID NO:313), and *Trichoderma* EG were assayed for AVICEL® hydrolysis. In these reactions, 10 units of CMCase of each enzyme were used to digest 1% AVICEL® at 60° C. (FIG. 29A) and 80° C. (FIG. 29B). Aliquots were taken to measure the products released at various time points; the data is illustrated as FIG. 29. At 60° C. (FIG. 29A), exemplary EGs of the invention outperformed the benchmark EG after approximately 5 h of incubation. Two exemplary EGs of the invention, SEQ ID NO:318 (encoded by, e.g., SEQ ID NO:317) and SEQ ID NO:314 (encoded by, e.g., SEQ ID NO:313), maintained Avicelase activity at 80° C. (FIG. 29B), while the benchmark EG was not active at this temperature. FIG. 29 illustrates the hydrolysis of AVICEL® by exemplary EGs under normalized conditions. Reducing sugar concentrations were measured at various time points for *Trichoderma* EG (open square), the exemplary EGs SEQ ID NO:318 (encoded by, e.g., SEQ ID NO:317) (solid diamond), SEQ ID NO:308 (encoded by, e.g., SEQ ID NO:307) (solid square), and SEQ ID NO:314 (encoded by, e.g., SEQ ID NO:313) (triangle).

The studies described in this study demonstrate the effectiveness of the exemplary thermostable EG enzymes of the invention in degradation of cellulosic materials (e.g. corn stover) at elevated temperatures. Thermostable EGs enzymes of the invention, e.g., those identified using the above-described methods, can be used to maximize a synergistic effect among them. In another aspect, enzymes of the invention are used in combination with other thermostable enzymes of the invention, including cellobiohydrolases and β-glucosidases. In another aspect, thermostable enzymes of the invention are used in combination with other (e.g., known) cellulases or related enzymes (e.g., thermostable enzymes), including cellobiohydrolases and β-glucosidases, which also can be thermostable, in various industrial processes, e.g., for processing biomass and/or hydrolyzing compositions comprising celluloses and/or lignocellulosic materials, e.g., from plants. The invention also provides processes utilizing thermostable enzymes of the invention at elevated temperatures, e.g., for use in biomass conversion, for example for the production of bioethanol.

Figure 30:
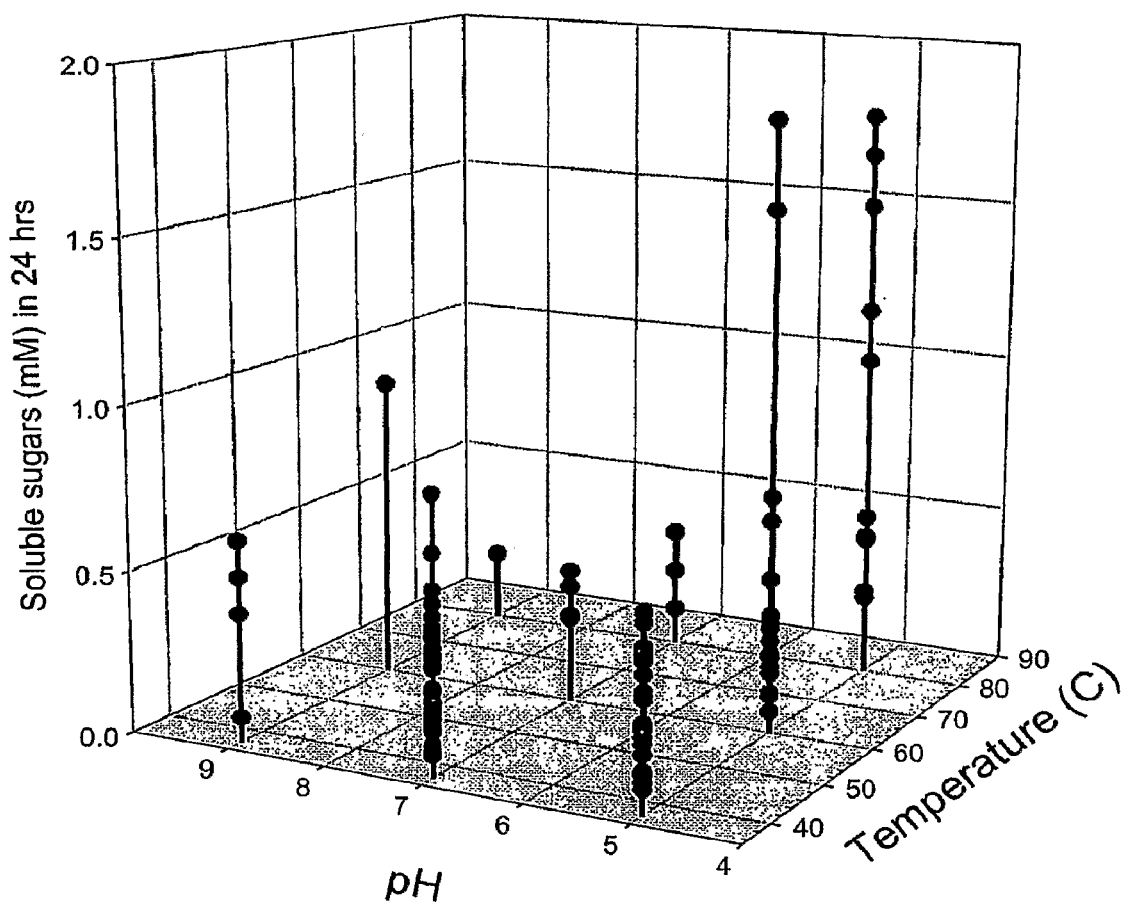
FIG. 30 graphically illustrates data showing the pH and temperature optima of exemplary enzymes on AVICEL® MCC; as discussed in detail in Example 8, below.

In one screening protocol, approximately 170 endoglucanase genes from environmental sources were subcloned and expressed, and then characterized on the soluble cellulose analog, carboxymethyl cellulose (CMC), and on AVICEL® MCC. Performance at pH 5, pH 7 and pH 9, and 37° C., 60° C. and 80° C. was assayed to define pH and temperature optima for each endoglucanase. Activity on AVICEL® MCC was assessed by measuring the release of soluble sugars after a 24 hr incubation with enzyme. Ninety-five of the endoglucanases digested MCC to some extent, as illustrated in FIG. 30. Of these, 21 were optimally active at 60° C. and 14 were optimally active at 80° C. FIG. 30 graphically illustrates data showing the pH and temperature optima of exemplary enzymes on AVICEL® MCC (1%). Soluble reducing sugars were measured with the bicinchoninic acid (BCA) calorimetric assay.

The highest level of digestion observed was approximately 30% to 40%, with extent of digestion dependent on the conditions of the assay, e.g., time, temperature and substrate concentration. The reaction stalled at this point, without going to completion. A combination of experiments suggested that the stalling was due to limited access to hydrolysable sites in the substrate, rather than to enzyme instability or product inhibition. This was supported by experiments with phosphoric acid—treated AVICEL® MCC; this substrate was 100% hydrolysable by the tested endoglucanases. Phosphoric acid treatment swells and reduces the crystallinity of cellulose, making it more accessible to enzymatic hydrolysis.

Complete digestion of AVICEL® MCC or pretreated corn stover can be accomplished using an enzyme cocktail of the invention, e.g., see discussion above. Enzyme mixtures of the invention that are effective for the breakdown (hydrolysis) of lignocellulosic material, e.g., on pretreated corn stover, include combinations of cellulase classes—including endoglucanases, β-glucosidases and cellobiohydrolases.

After identifying and characterizing thermostable endoglucanases of the invention having activity (hydrolysis activity) on AVICEL® microcrystalline cellulose (MCC) and are capable of hydrolysis of cellulose and pretreated material, enzymes of the invention were further characterized for their ability to hydrolyze cellulose-comprising materials, e.g., a plant material, such as pretreated corn stover (PCS). As noted above, AVICEL®, which is 50-60% crystalline, was chosen as the model substrate with the expectation that performance on AVICEL® MCC would be predictive of performance on pretreated corn stover (PCS); noting this performance may not be predictive for all types of pretreated samples.

As noted above, approximately 170 endoglucanase genes from environmental sources and 95 enzymes were shown to digest MCC to some extent. Of these, 21 were optimally active at 60° C. and 14 were optimally active at 80° C. Three different PCS samples were used: steam PCS, dilute acid PCS and severe alkaline PCS. These differ in chemical (composition) and physical properties. All endoglucanases were tested for the ability to release soluble sugar from these three PCS samples using an automated, medium throughput screen. The assays were performed at pH 5 or 7, 37° C., 50° C. or 80° C. with 1% of substrate as glucose and 1 mg/ml total protein (crude extracts). Product was analyzed by a reducing sugar assay. Certain reactions were scaled up and product was analyzed by HPLC.

The Table below lists the exemplary enzymes tested along with the amount of reducing sugar produced from AVICEL® MCC and whether any reducing sugar was observed from the reaction with the three PCS samples (Y=yes). Included in the table is the amount of conversion for severe alkaline PCS in 24 hrs. No entry indicates that there was no product formation.

There does not seem to be a correlation between performance on AVICEL® MCC and performance on alkaline PCS. For example, the exemplary enzyme SEQ ID NO:106 (encoded by, e.g., SEQ ID NO:105) performed the best on alk PCS but produced about half the amount of product on AVICEL® MCC as compared to the exemplary enzyme SEQ ID NO:434 (encoded by, e.g., SEQ ID NO:433). Furthermore, several clones were active on alkPCS but inactive on AVICEL® MCC (see the exemplary enzymes SEQ ID NO:202 (encoded by, e.g., SEQ ID NO:201), 10848 and 13626). Twenty-one enzymes have activity on alkPCS. Conversion can be improved by the addition of other enzymatic activities, e.g., the addition of other enzymes, which can be another enzyme of the invention, or an unrelated enzyme, e.g., any enzyme having cellobiohydrolase, β-glucosidase and "hemicellulase" activity.

| Enzyme name | [sugar] from AVICEL ® in 24 hr reaction | Steam PCS | acid PCS | Severe alkPCS (% conversion) |
|---|---|---|---|---|
| SEQ ID NO: 434 (encoded, e.g., by SEQ ID NO: 433) | 1.79 | | | |
| SEQ ID NO: 156 (encoded, e.g., by SEQ ID NO: 155) | 1.67 | | | Y (1.5) |
| SEQ ID NO: 308 (encoded, e.g., by SEQ ID NO: 307) | 1.59 | | Y | Y (2.3) |
| SEQ ID NO: 318 (encoded, e.g., by SEQ ID NO: 317) | 1.51 | Y | Y | Y (3.1) |
| SEQ ID NO: 372 (encoded, e.g., by SEQ ID NO: 371) | 1.18 | | | |
| SEQ ID NO: 314 (encoded, e.g., by SEQ ID NO: 313) | 1.02 | | | Y (1.4) |
| SEQ ID NO: 302 (encoded, e.g., by SEQ ID NO: 301) | 0.94 | | | Y (1.9) |
| SEQ ID NO: 106 (encoded, e.g., by SEQ ID NO: 105) | 0.84 | Y | Y | Y (8.8) |
| SEQ ID NO: 120 (encoded, e.g., by SEQ ID NO: 119) | 0.83 | Y | | |
| SEQ ID NO: 126 (encoded, e.g., by SEQ ID NO: 125) | 0.73 | | Y | |
| SEQ ID NO: 110 (encoded, e.g., by SEQ ID NO: 109) | 0.67 | | | |
| SEQ ID NO: 146 (encoded, e.g., by SEQ ID NO: 145) | 0.66 | | Y | Y (2.3) |
| SEQ ID NO: 354 (encoded, e.g., by SEQ ID NO: 353) | 0.62 | | | |
| SEQ ID NO: 160 (encoded, e.g., by SEQ ID NO: 159) | 0.59 | | | Y (5.5) |
| SEQ ID NO: 176 (encoded, e.g., by SEQ ID NO: 175) | 0.56 | | | |
| SEQ ID NO: 236 (encoded, e.g., by SEQ ID NO: 235) | 0.56 | | | |
| SEQ ID NO: 246 (encoded, e.g., by SEQ ID NO: 245) | 0.52 | | | |
| SEQ ID NO: 216 (encoded, e.g., by SEQ ID NO: 215) | 0.51 | | | |
| SEQ ID NO: 296 (encoded, e.g., by SEQ ID NO: 295) | 0.51 | | | |
| SEQ ID NO: 256 (encoded, e.g., by SEQ ID NO: 255) | 0.49 | | | Y (4.2) |
| SEQ ID NO: 186 (encoded, e.g., by SEQ ID NO: 185) | 0.48 | | | Y (5) |
| SEQ ID NO: 124 (encoded, e.g., by SEQ ID NO: 123) | 0.48 | | | |
| SEQ ID NO: 162 (encoded, e.g., by SEQ ID NO: 161) | 0.48 | | | |
| SEQ ID NO: 270 (encoded, e.g., by SEQ ID NO: 269) | 0.46 | | | |
| SEQ ID NO: 276 (encoded, e.g., by SEQ ID NO: 275) | 0.45 | | | |
| SEQ ID NO: 190 (encoded, e.g., by SEQ ID NO: 189) | 0.45 | | | |
| SEQ ID NO: 274 (encoded, e.g., by SEQ ID NO: 273) | 0.45 | | | |
| SEQ ID NO: 214 (encoded, e.g., by SEQ ID NO: 213) | 0.44 | | | |
| SEQ ID NO: 290 (encoded, e.g., by SEQ ID NO: 289) | 0.44 | | | |
| SEQ ID NO: 306 (encoded, e.g., by SEQ ID NO: 305) | 0.42 | | | |
| SEQ ID NO: 118 (encoded, e.g., by SEQ ID NO: 117) | 0.42 | | | |
| SEQ ID NO: 30 (encoded, e.g., by SEQ ID NO: 29) | 0.42 | | | |
| SEQ ID NO: 144 (encoded, e.g., by SEQ ID NO: 143) | 0.41 | | | |
| SEQ ID NO: 134 (encoded, e.g., by SEQ ID NO: 133) | 0.4 | | | |
| SEQ ID NO: 194 (encoded, e.g., by SEQ ID NO: 193) | 0.39 | | | |
| SEQ ID NO: 210 (encoded, e.g., by SEQ ID NO: 209) | 0.39 | | | |
| SEQ ID NO: 240 (ENCODED BY SEQ ID NO: 239) | 0.38 | | Y | Y (2) |
| SEQ ID NO: 278 (ENCODED BY SEQ ID NO: 277) | 0.37 | | | |
| SEQ ID NO: 294 (ENCODED BY SEQ ID NO: 293) | 0.37 | | | |
| SEQ ID NO: 170 (ENCODED BY SEQ ID NO: 169) | 0.37 | | | |
| SEQ ID NO: 208 (ENCODED BY SEQ ID NO: 207) | 0.37 | | | |
| SEQ ID NO: 128 (ENCODED BY SEQ ID NO: 127) | 0.36 | | | |
| SEQ ID NO: 132 (ENCODED BY SEQ ID NO: 131) | 0.36 | | | |
| SEQ ID NO: 158 (ENCODED BY SEQ ID NO: 157) | 0.36 | | | |
| SEQ ID NO: 178 (ENCODED BY SEQ ID NO: 177) | 0.36 | | | |
| SEQ ID NO: 166 (ENCODED BY SEQ ID NO: 165) | 0.34 | | | |
| SEQ ID NO: 196 (ENCODED BY SEQ ID NO: 195) | 0.34 | | Y | Y (8.2) |
| SEQ ID NO: 204 (ENCODED BY SEQ ID NO: 203) | 0.34 | | | |
| SEQ ID NO: 218 (ENCODED BY SEQ ID NO: 217) | 0.33 | | Y | |
| SEQ ID NO: 242 (ENCODED BY SEQ ID NO: 243) | 0.33 | | | |
| SEQ ID NO: 154 (ENCODED BY SEQ ID NO: 153) | 0.29 | | | Y (5.6) |
| SEQ ID NO: 300 (ENCODED BY SEQ ID NO: 299) | 0.28 | | | |
| SEQ ID NO: 338 (ENCODED BY SEQ ID NO: 337) | 0.27 | | | |
| SEQ ID NO: 284 (ENCODED BY SEQ ID NO: 283) | 0.27 | | | |
| SEQ ID NO: 112 (ENCODED BY SEQ ID NO: 111) | 0.27 | | | |
| SEQ ID NO: 224 (ENCODED BY SEQ ID NO: 223) | 0.27 | | | |
| SEQ ID NO: 136 (ENCODED BY SEQ ID NO: 135) | 0.26 | | | |
| SEQ ID NO: 430 (ENCODED BY SEQ ID NO: 429) | 0.26 | | | |
| SEQ ID NO: 198 (ENCODED BY SEQ ID NO: 197) | 0.25 | Y | Y | |
| SEQ ID NO: 428 (ENCODED BY SEQ ID NO: 427) | 0.25 | Y | | Y (2.6) |
| SEQ ID NO: 282 (ENCODED BY SEQ ID NO: 281) | 0.25 | | | |
| SEQ ID NO: 268 (ENCODED BY SEQ ID NO: 267) | 0.25 | | | |
| SEQ ID NO: 152 (ENCODED BY SEQ ID NO: 151) | 0.24 | Y | | Y (5.7) |
| SEQ ID NO: 38 (ENCODED BY SEQ ID NO: 37) | 0.23 | | | |
| SEQ ID NO: 292 (ENCODED BY SEQ ID NO: 291) | 0.23 | | | |
| SEQ ID NO: 232 (ENCODED BY SEQ ID NO: 231) | 0.23 | | | |
| SEQ ID NO: 234 (ENCODED BY SEQ ID NO: 233) | 0.22 | | | |
| SEQ ID NO: 122 (ENCODED BY SEQ ID NO: 121) | 0.22 | | | |
| SEQ ID NO: 142 (ENCODED BY SEQ ID NO: 141) | 0.22 | | | |
| SEQ ID NO: 244 (ENCODED BY SEQ ID NO: 243) | 0.21 | | | |
| SEQ ID NO: 138 (ENCODED BY SEQ ID NO: 137) | 0.21 | | | |
| SEQ ID NO: 200 (ENCODED BY SEQ ID NO: 199) | 0.21 | | | |
| SEQ ID NO: 116 (ENCODED BY SEQ ID NO: 115) | 0.19 | | Y | Y (4.2) |
| SEQ ID NO: 114 (ENCODED BY SEQ ID NO: 113) | 0.19 | | | |
| SEQ ID NO: 248 (ENCODED BY SEQ ID NO: 247) | 0.19 | | | |
| SEQ ID NO: 360 (ENCODED BY SEQ ID NO: 359) | 0.18 | | | |

-continued

| Enzyme name | [sugar] from AVICEL ® in 24 hr reaction | Steam PCS | acid PCS | Severe alkPCS (% conversion) |
|---|---|---|---|---|
| SEQ ID NO: 184 (ENCODED BY SEQ ID NO: 183) | 0.18 | | | |
| SEQ ID NO: 192 (encoded by SEQ ID NO: 191) | 0.18 | | | |
| SEQ ID NO: 222 (ENCODED BY SEQ ID NO: 221) | 0.17 | | | |
| SEQ ID NO: 140 (ENCODED BY SEQ ID NO: 139) | 0.16 | | | |
| SEQ ID NO: 168 (ENCODED BY SEQ ID NO: 167) | 0.14 | Y | | |
| SEQ ID NO: 182 (ENCODED BY SEQ ID NO: 181) | 0.13 | | | |
| SEQ ID NO: 220 (ENCODED BY SEQ ID NO: 219) | 0.13 | | | |
| SEQ ID NO: 260 (ENCODED BY SEQ ID NO: 259) | 0.13 | | | |
| SEQ ID NO: 262 (ENCODED BY SEQ ID NO: 261) | 0.12 | | Y | Y (0.4) |
| SEQ ID NO: 280 (ENCODED BY SEQ ID NO: 279) | 0.12 | | | |
| SEQ ID NO: 258 (ENCODED BY SEQ ID NO: 257) | 0.12 | | | |
| SEQ ID NO: 108 (ENCODED BY SEQ ID NO: 107) | 0.1 | | | |
| SEQ ID NO: 206 (ENCODED BY SEQ ID NO: 205) | 0.1 | | | |
| SEQ ID NO: 130 (ENCODED BY SEQ ID NO: 129) | 0.08 | | | |
| SEQ ID NO: 138 (ENCODED BY SEQ ID NO: 137) | 0.08 | | | |
| SEQ ID NO: 286 (ENCODED BY SEQ ID NO: 285) | 0.08 | | | |
| SEQ ID NO: 316 (ENCODED BY SEQ ID NO: 315) | 0.07 | | | Y (3) |
| SEQ ID NO: 296 (ENCODED BY SEQ ID NO: 295) | 0.07 | | | |
| SEQ ID NO: 288 (ENCODED BY SEQ ID NO: 287) | 0.07 | | | |
| SEQ ID NO: 202 (ENCODED BY SEQ ID NO: 201) | 0 | Y | Y | Y (4.9) |
| SEQ ID NO: 174 (ENCODED BY SEQ ID NO: 173) | 0 | | Y | |
| SEQ ID NO: 238 (ENCODED BY SEQ ID NO: 237) | 0 | | | Y (1.3) |
| SEQ ID NO: 416 (ENCODED BY SEQ ID NO: 415) | 0 | | | Y (1.7) |

Example 9

Identification and Characterization of Cellobiohydrolases and β-Glucosidases

This example describes the identification and characterization of cellobiohydrolases (CBHs) and β-glucosidases of the invention. In one aspect, CBHs and β-glucosidases of the invention are used to complement the hydrolysis activity of endoglucanases used to practice the methods of the invention, e.g., the endoglucanases of the invention, as discussed above. In summary, 89 active β-glucosidases of the invention and 28 active cellobiohydrolases of the invention were characterized.

Figure 31:
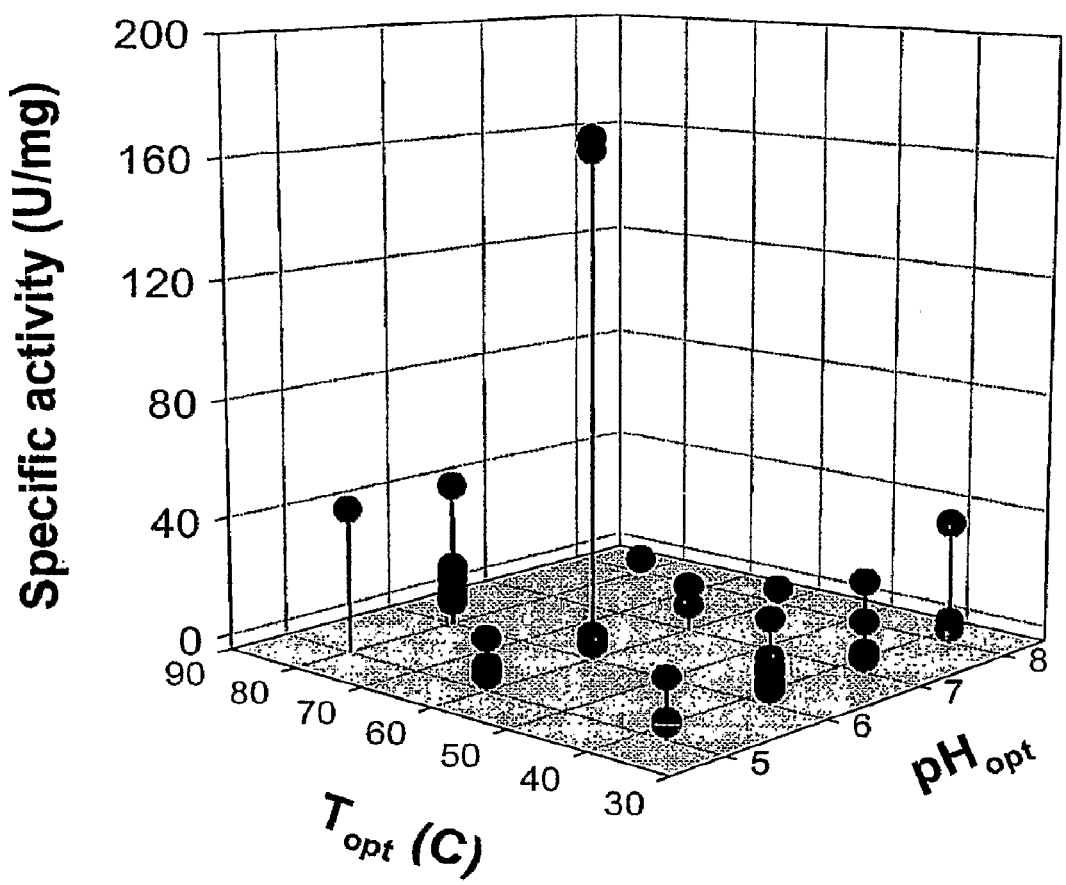
FIG. 31 graphically illustrates data showing the pH and temperature optima of 89 β-glucosidases of the invention; as discussed in detail in Example 9, below.

Discovery was a combination of activity-based screens using model substrates (dye labeled sugars) and sequence-based discovery using probes designed from conserved sequences of known family 6 and 7 cellobiohydrolases. β-glucosidase discovery utilized a large number of bacterial gene libraries, mainly focusing on libraries generated from high temperature environments. New β-glucosidase enzymes of the invention so identified were subcloned into appropriate expression vectors and characterized for activity on dye-labeled substrates, as well as cellobiose and cellohexaose. Both pH and temperature optima were determined for each enzyme. In total 93 genes were analyzed for activity. Of the 93 subclones, 89 were shown to be active on the dye labeled substrate, pNP-β-glucopyranoside, see FIG. 31 and the Table, below. FIG. 31 graphically illustrates data showing the pH and temperature optima of 89 β-glucosidases of the invention. Exemplary β-glucosidases of the invention with $pH_{opt}$, $T_{opt}$ and specific activity on pNP-beta-glucopyranoside (pNP-β-glucopyranoside) are:

| Enzyme | pHopt | Topt | SA (U/mg) |
|---|---|---|---|
| SEQ ID NO: 254 (encoded by SEQ ID NO: 253) | 5 | 60 | 2.25 |
| SEQ ID NO: 264 (encoded by SEQ ID NO: 263) | 5 | 80 | 43.93 |
| SEQ ID NO: 340 (encoded by SEQ ID NO: 339) | 7 | 60 | 10.86 |
| SEQ ID NO: 364 (encoded by SEQ ID NO: 363) | 5 | 60 | 3.83 |
| SEQ ID NO: 356 (encoded by SEQ ID NO: 355) | 6 | 60 | 0.89 |
| SEQ ID NO: 326 (encoded by SEQ ID NO: 325) | 5 | 37 | 14.94 |
| SEQ ID NO: 358 (encoded by SEQ ID NO: 357) | 7 | 60 | 4.06 |
| SEQ ID NO: 320 (encoded by SEQ ID NO: 319) | 6 | 60 | 2.75 |
| SEQ ID NO: 346 (encoded by SEQ ID NO: 345) | 6 | 37 | 0.43 |
| SEQ ID NO: 348 (encoded by SEQ ID NO: 347) | 6 | 60 | 0.264 |
| SEQ ID NO: 362 (encoded by SEQ ID NO: 361) | 6 | 80 | 3 |
| SEQ ID NO: 342 (encoded by SEQ ID NO: 341) | 6 | 60 | 3.5 |
| SEQ ID NO: 336 (encoded by SEQ ID NO: 335) | 7 | 37 | 0.00728 |
| SEQ ID NO: 352 (encoded by SEQ ID NO: 351) | 6 | 80 | 13.5 |
| SEQ ID NO: 304 (encoded by SEQ ID NO: 303) | 5 | 60 | 0.5 |
| SEQ ID NO: 322 (encoded by SEQ ID NO: 321) | 6 | 37 | 8.02 |
| SEQ ID NO: 432 (encoded by SEQ ID NO: 431) | 6 | 60 | 0.7 |
| SEQ ID NO: 226 (encoded by SEQ ID NO: 225) | 6 | 37 | 0.185 |
| SEQ ID NO: 228 (encoded by SEQ ID NO: 227) | 5 | 60 | 0.31 |
| SEQ ID NO: 312 (encoded by SEQ ID NO: 311) | 7 | 37 | 0.38 |
| SEQ ID NO: 370 (encoded by SEQ ID NO: 369) | 5 | 37 | 0.21 |
| SEQ ID NO: 404 (encoded by SEQ ID NO: 403) | 5 | 37 | 0.229 |
| SEQ ID NO: 420 (encoded by SEQ ID NO: 419) | 6 | 37 | 2.883 |
| SEQ ID NO: 400 (encoded by SEQ ID NO: 399) | 6 | 37 | 2.369 |

-continued

| Enzyme | pHopt | Topt | SA (U/mg) |
|---|---|---|---|
| SEQ ID NO: 384 (encoded by SEQ ID NO: 383) | 7 | 37 | 0.88 |
| SEQ ID NO: 24 (encoded by SEQ ID NO: 23) | 8 | 37 | 2.743 |
| SEQ ID NO: 42 (encoded by SEQ ID NO: 41) | 5 | 37 | 1.57 |
| SEQ ID NO: 408 (encoded by SEQ ID NO: 407) | 6 | 37 | 23.083 |
| SEQ ID NO: 382 (encoded by SEQ ID NO: 381) | 6 | 60 | 1.82 |
| SEQ ID NO: 228 (encoded by SEQ ID NO: 227) | 6 | 37 | 6.77 |
| SEQ ID NO: 344 (encoded by SEQ ID NO: 343) | 5 | 37 | 0.0339 |
| SEQ ID NO: 332 (encoded by SEQ ID NO: 331) | 5 | 37 | 0.492 |
| SEQ ID NO: 150 (encoded by SEQ ID NO: 149) | 6 | 80 | 4.26 |
| SEQ ID NO: 230 (encoded by SEQ ID NO: 229) | 6 | 37 | 2.699 |
| SEQ ID NO: 310 (encoded by SEQ ID NO: 309) | 7 | 37 | 0.963 |
| SEQ ID NO: 94 (encoded by SEQ ID NO: 93) | 6 | 60 | 164.026 |
| SEQ ID NO: 6 (encoded by SEQ ID NO: 5) | 5 | 37 | 0.263 |
| SEQ ID NO: 298 (encoded by SEQ ID NO: 297) | 5 | 37 | 0.172 |
| SEQ ID NO: 376 (encoded by SEQ ID NO: 375) | 5 | 37 | 0.489 |
| SEQ ID NO: 148 (encoded by SEQ ID NO: 147) | 5 | 37 | 0.24 |
| SEQ ID NO: 386 (encoded by SEQ ID NO: 385) | 5 | 37 | 0.25 |
| SEQ ID NO: 350 (encoded by SEQ ID NO: 349) | 5 | 37 | 0.172 |
| SEQ ID NO: 18 (encoded by SEQ ID NO: 17) | 5 | 37 | 0.346 |
| SEQ ID NO: 50 (encoded by SEQ ID NO: 49) | 5 | 37 | 0.619 |
| SEQ ID NO: 424 (encoded by SEQ ID NO: 423) | 6 | 37 | 10.263 |
| SEQ ID NO: 422 (encoded by SEQ ID NO: 421) | 5 | 37 | 0.178 |
| SEQ ID NO: 8 (encoded by SEQ ID NO: 7) | 5 | 37 | 0.0879 |
| SEQ ID NO: 212 (encoded by SEQ ID NO: 211) | 8 | 37 | 0.228 |
| SEQ ID NO: 366 (encoded by SEQ ID NO: 365) | 8 | 80 | 0.052 |
| SEQ ID NO: 380 (encoded by SEQ ID NO: 379) | 5 | 37 | 0.336 |
| SEQ ID NO: 58 (encoded by SEQ ID NO: 57) | 5 | 37 | 0.0455 |
| SEQ ID NO: 58 (encoded by SEQ ID NO: 57) | 5 | 37 | 0.0181 |
| SEQ ID NO: 388 (encoded by SEQ ID NO: 387) | 6 | 60 | 168 |
| SEQ ID NO: 4 (encoded by SEQ ID NO: 3) | 6 | 37 | 0.506 |
| SEQ ID NO: 76 (encoded by SEQ ID NO: 75) | 5 | 60 | 0.73 |
| SEQ ID NO: 90 (encoded by SEQ ID NO: 89) | 5 | 60 | 12.6 |
| SEQ ID NO: 328 (encoded by SEQ ID NO: 327) | 6 | 60 | 0.16 |
| SEQ ID NO: 334 (encoded by SEQ ID NO: 333) | 5 | 60 | 3.09 |
| SEQ ID NO: 16 (encoded by SEQ ID NO: 15) | 6 | 60 | 1.08 |
| SEQ ID NO: 30 (encoded by SEQ ID NO: 29) | 8 | 37 | 36.6 |
| SEQ ID NO: 374 (encoded by SEQ ID NO: 373) | 5 | 37 | 0.027 |
| SEQ ID NO: 394 (encoded by SEQ ID NO: 393) | 6 | 60 | 1.91 |
| SEQ ID NO: 330 (encoded by SEQ ID NO: 329) | 7 | 37 | 12.3 |
| SEQ ID NO: 164 (encoded by SEQ ID NO: 163) | 8 | 60 | 0.35 |
| SEQ ID NO: 378 (encoded by SEQ ID NO: 377) | 5 | 37 | 0.033 |
| SEQ ID NO: 410 (encoded by SEQ ID NO: 409) | 5 | 37 | 0.29 |
| SEQ ID NO: 418 (encoded by SEQ ID NO: 417) | 5 | 37 | 0.02 |
| SEQ ID NO: 70 (encoded by SEQ ID NO: 69) | 6 | 37 | 0.77 |
| SEQ ID NO: 412 (encoded by SEQ ID NO: 411) | 5 | 37 | 0.12 |
| SEQ ID NO: 398 (encoded by SEQ ID NO: 397) | 6 | 60 | 2.26 |
| SEQ ID NO: 272 (encoded by SEQ ID NO: 271) | 6 | 37 | 1.49 |
| SEQ ID NO: 324 (encoded by SEQ ID NO: 323) | 7 | 37 | 2.31 |
| SEQ ID NO: 172 (encoded by SEQ ID NO: 171) | 5 | 60 | 1.97 |
| SEQ ID NO: 188 (encoded by SEQ ID NO: 187) | 6 | 80 | 7.06 |
| SEQ ID NO: 250 (encoded by SEQ ID NO: 249) | 6 | 80 | 15.35 |
| SEQ ID NO: 252 (encoded by SEQ ID NO: 251) | 6 | 80 | 11.21 |
| SEQ ID NO: 180 (encoded by SEQ ID NO: 179) | 5 | 37 | 0.03 |
| SEQ ID NO: 368 (encoded by SEQ ID NO: 367) | 5 | 37 | 0.1 |
| SEQ ID NO: 266 (encoded by SEQ ID NO: 265) | 7 | 37 | 0.04 |
| SEQ ID NO: 414 (encoded by SEQ ID NO: 413) | 5 | 37 | 0.071 |
| SEQ ID NO: 390 (encoded by SEQ ID NO: 389) | 5 | 37 | 0.01 |
| SEQ ID NO: 402 (encoded by SEQ ID NO: 401) | 6 | 37 | 10.6 |
| SEQ ID NO: 426 (encoded by SEQ ID NO: 425) | 7 | 37 | 25.7 |
| SEQ ID NO: 392 (encoded by SEQ ID NO: 391) | 6 | 80 | 44 |
| SEQ ID NO: 396 (encoded by SEQ ID NO: 395) | 6 | 37 | 5.7 |
| SEQ ID NO: 406 (encoded by SEQ ID NO: 405) | 5 | 37 | 0.17 |
| SEQ ID NO: 438 (encoded by SEQ ID NO: 437) | 5 | 37 | 0.2 |
| SEQ ID NO: 436 (encoded by SEQ ID NO: 435) | 6 | 37 | 0.004 |
| SEQ ID NO: 492 (encoded by SEQ ID NO: 491) | 6 | 37 | 2.5 |

The activity of the exemplary SEQ ID NO:264 (ENCODED BY SEQ ID NO:263), SEQ ID NO:94 (encoded by SEQ ID NO:93) and SEQ ID NO:388 (encoded by SEQ ID NO:387) enzymes was tested on cellobiose and cellohexaose. The exemplary SEQ ID NO:94 (ENCODED BY SEQ ID NO:93) and SEQ ID NO:388 (encoded by SEQ ID NO:387) both were significantly more active on cellohexaose than on cellobiose while SEQ ID NO:264 (ENCODED BY SEQ ID NO:263) had almost equivalent activity on these two substrates. The $K_m$ for cellobiose of SEQ ID NO:264 (ENCODED BY SEQ ID NO:263) was determined to be approximately 2.5 mM; consistent with literature values for other similar enzymes. Based on these results the exemplary SEQ ID NO:264 (ENCODED BY SEQ ID NO:263) was chosen as the top candidate to be used in the enzyme cocktails.

Figure 32:
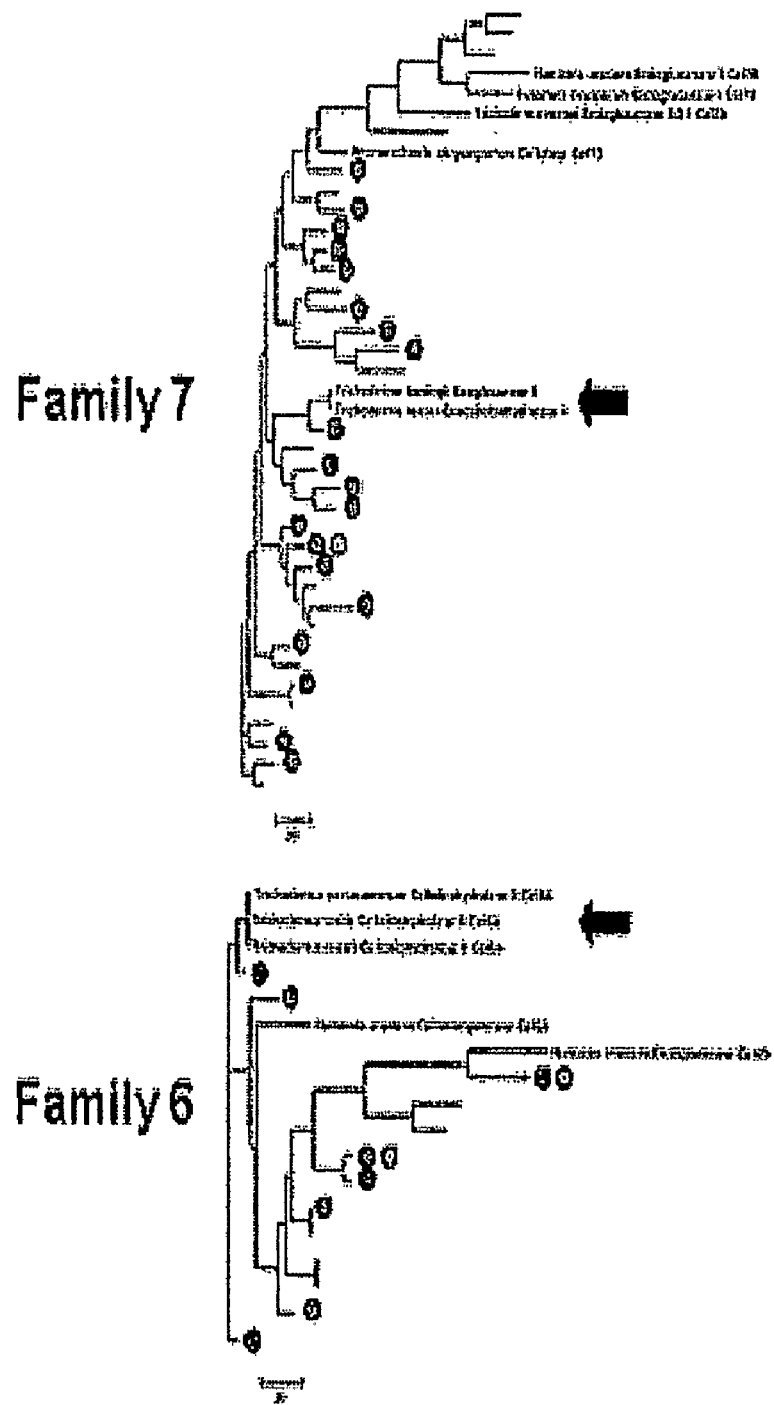
FIG. 32 illustrates phylogenetic trees of CBH genes of the invention; as discussed in detail in Example 9, below.

The protocols and design for discovery and characterization of CBH genes and enzymes were similar to those for the discovery and characterization of β-glucosidases of the invention, as discussed herein. Considering that all previously reported Family 6 and 7 cellobiohydrolases have been found in the fungi, we screened 150 strains from fungal libraries for the ability to degrade biomass, e.g., using pretreated corn stover. Nucleic acids (DNA and mRNA) were isolated from the positive strains and both genomic DNA and cDNA were probed for the presence of family 6 and 7 genes. Full length genes were recovered (with and without introns) and cloned into eukaryotic expression systems (Pichia, baculovirus and *Cochliobolus heterostrophus*). In total 41 full length genes were identified and analyzed. All 41 were cloned into *Pichia* and *Cochliobolus*; two were shown to be active in the *Pichia* constructs while 28 were active in the *Cochliobolus* constructs, as shown by the illustrated enzyme phylogenetic trees in FIG. 32. Activity was measured on AVICEL® microcrystalline cellulose and phosphoric acid swollen cellulose (PASC). FIG. 32 illustrates phylogenetic trees of discovered CBH genes of the invention; the blue arrows highlight *T. reesei* sequences. Genes that expressed and produced active protein in *Pichia* are indicated by the light blue symbols; those active in baculovirus are indicated by the yellow symbol and those active in *Cochliobolus* are indicated by the red symbols.

Example 10

Optimizing Content of Enzyme Cocktails of the Invention

This example describes the exemplary methods to accurately determine active enzyme in crude protein mixtures in order to optimize the composition of the enzyme cocktails of the invention and reduce overall protein content.

A combination of protein purification, SDS-PAGE analysis and enzyme assays allowed a semi-quantitative measure of the amount of active enzyme in each of the crude preparations. A systematic approach was taken to remove redundant and unnecessary enzymes from an exemplary enzyme mixture of the invention, the so-called "E10 cocktail". It was determined that two of the enzymes, SEQ ID NO:442 (ENCODED BY SEQ ID NO:441) (α-glucuronidase) and SEQ ID NO:440 (ENCODED BY SEQ ID NO:439) (ferulic acid esterase) contributed very little to overall performance and were removed from the cocktail resulting in an "E8" mixture. Experiments were carried out to determine which of the cellobiohydrolases (CBH I, CBH II, SEQ ID NO:98 (ENCODED BY SEQ ID NO:97) and SEQ ID NO:34 (ENCODED BY SEQ ID NO:33)) were the most effective in the cocktails. The performance from three different mixes was assessed (Case 1, 2 and 3).

Be composition of each of these mixes is shown in the tables illustrated in FIG. 57 (Case 1—CBH I/CBH II), FIG. 58 (Case 2—CBH I/SEQ ID NO:98 (ENCODED BY SEQ ID NO:97)), and FIG. 59 (Case 3—SEQ ID NO:34 (ENCODED BY SEQ ID NO:33)/SEQ ID NO:98 (ENCODED BY SEQ ID NO:97)). The tables show how much of each enzyme was used in the cocktails and estimates of active enzyme in each of these preparations. In addition, the tables show data calculated as mg enzyme/g cellulose for each reaction. In all three cases the total enzyme composition was tabulated and was below the 20 mg/g cellulose limited outlined in the target (case 1=17.2 mg/g; case 2=18.1 mg/g and case 3=16 mg/g).

Figure 60:
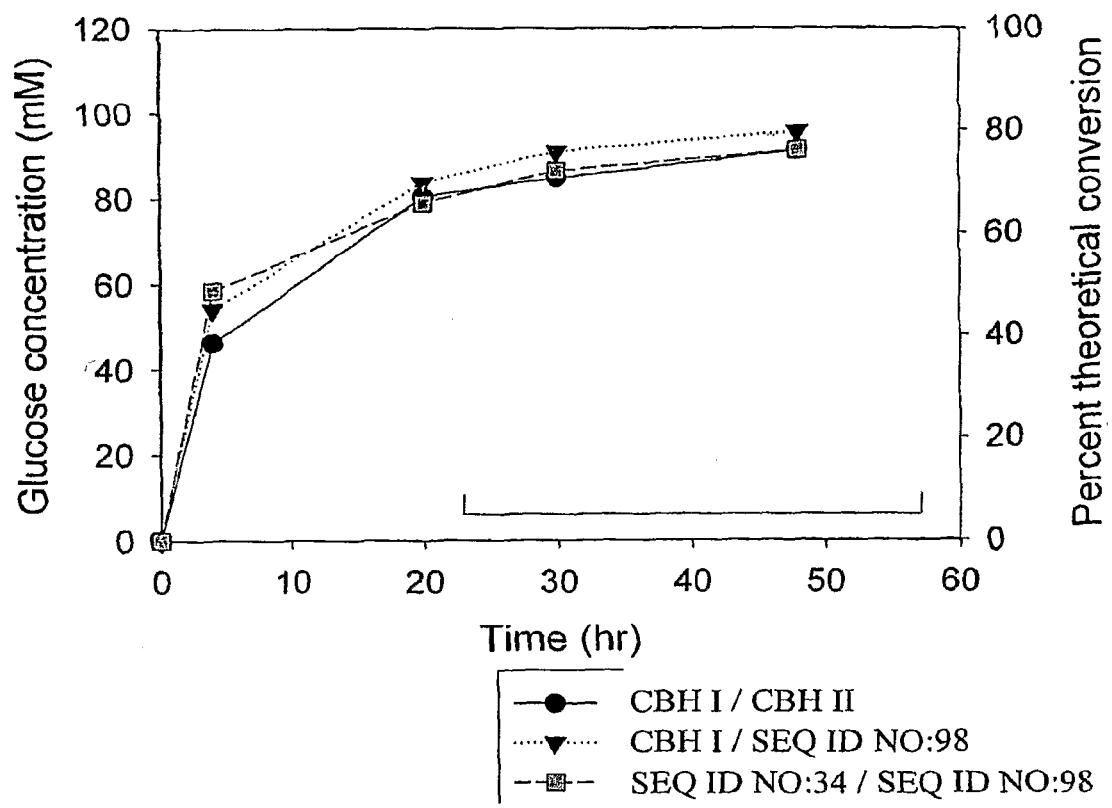
FIG. 60 graphically illustrates data demonstrating glucose release from 5% solids is pretreated corn cob catalyzed by three different exemplary E8 cocktails; as discussed in detail in Example 10, below.
Figure 61:
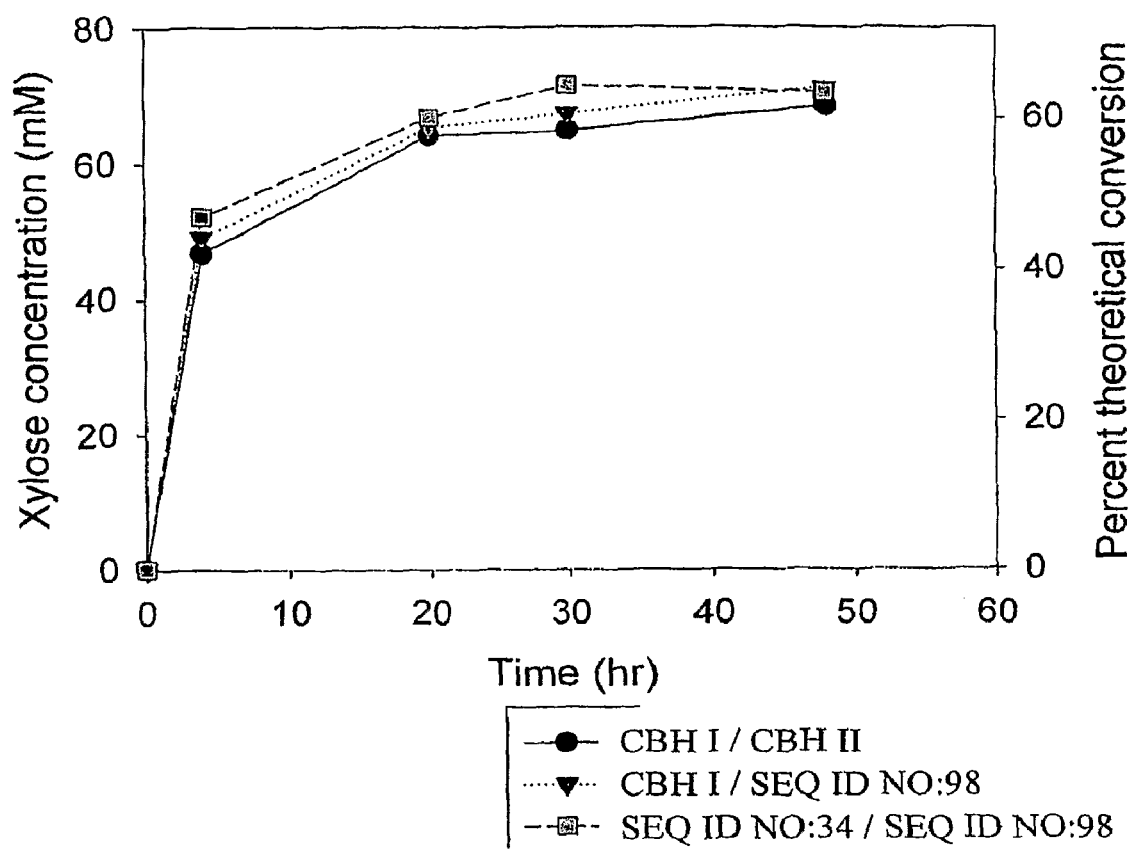
FIG. 61 graphically illustrates data demonstrating xylose release from 5% solids pretreated corn cob catalyzed by three different exemplary E8 cocktails; as discussed in detail in Example 10, below.
Figure 62:
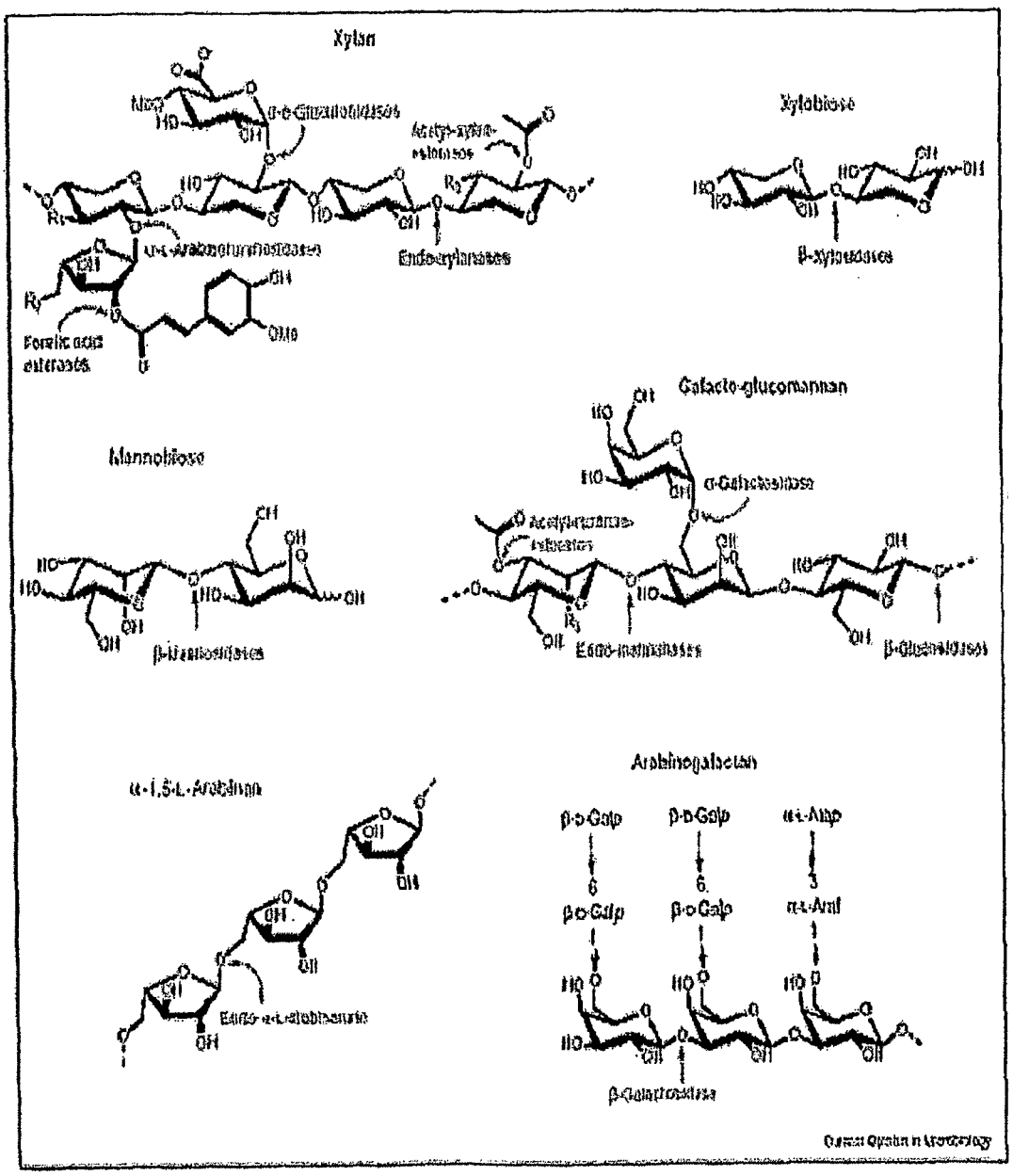
FIGS. 62 and 63 are schematic illustrations of the enzymatically driven pathway for digesting cellulose (FIG. 63) and hemicellulose (FIG. 62); as discussed in detail in Example 11, below.
Figure 63:
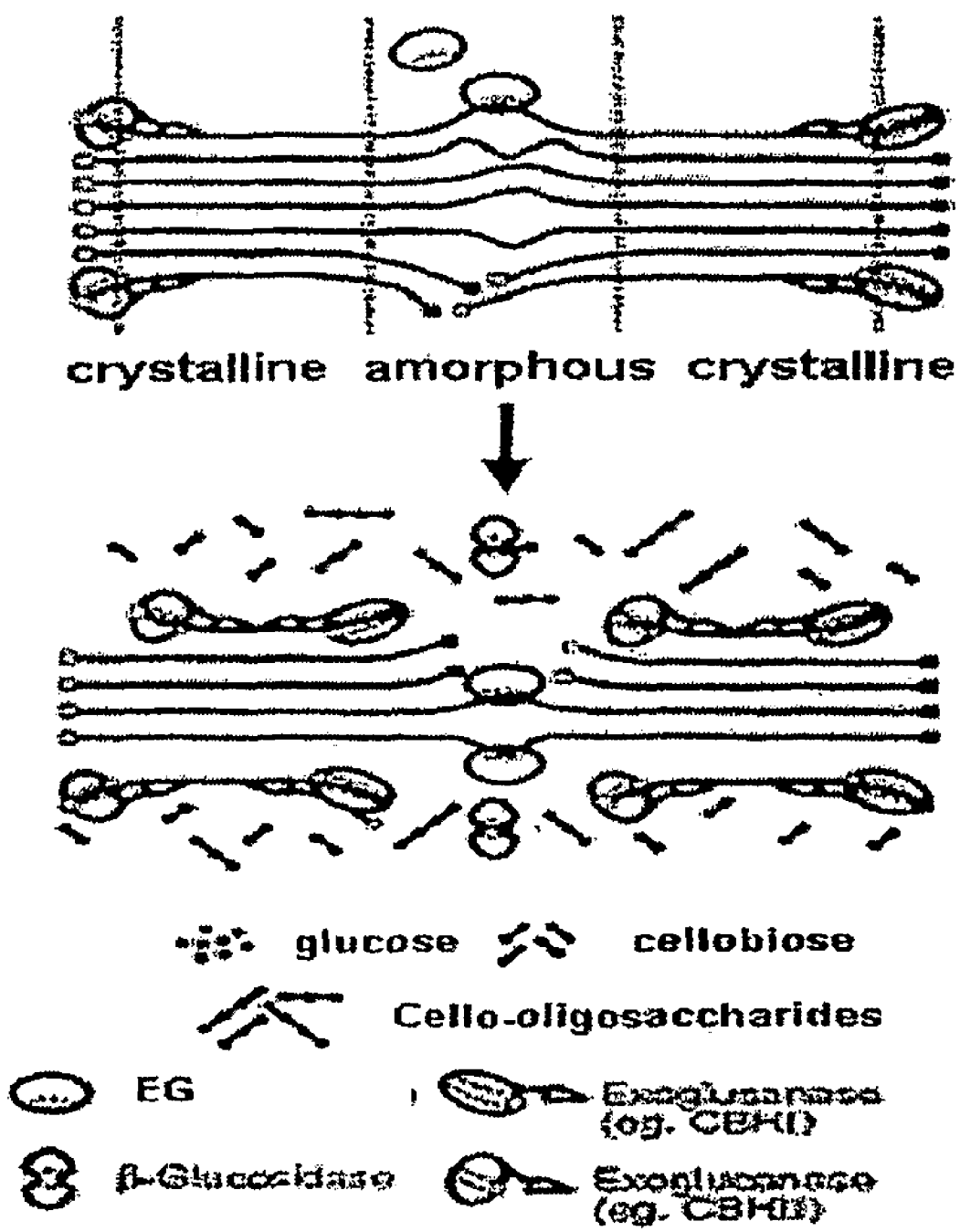

FIGS. 60 and 61 show the time courses of saccharification of Jaygo 2 (5% solids pretreated corn cob) using these three enzyme mixes (Case 1, 2 and 3, FIGS. 57 to 59, respectively). While there were some minor differences in rates between the cases all three resulted in almost exactly 80% recovery of glucose and 62% recovery of xylose within 48 hrs. FIG. 60 data shows glucose release from Jaygo 2 (5% solids) catalyzed by three different exemplary E8 cocktails: CBH I/CBH II is Case 1 table; CBH I/SEQ ID NO:98 (ENCODED BY SEQ ID NO:97) is Case 2 table and SEQ ID NO:34 (ENCODED BY SEQ ID NO:33)/SEQ ID NO:98 (ENCODED BY SEQ ID NO:97) is the Case 3 table. Glucose concentration was determined by HPLC analysis of the saccharified liquors sampled at 4, 20, 30 and 48 hrs. Percent conversion was calculated by using 120 mM as 100% available glucose in the pretreated solids. Reaction conditions are pH 5.5 and 50° C.

FIG. 61 data shows xylose release from Jaygo 2 (5% solids pretreated corn cob) catalyzed by three different exemplary E8 cocktails: CBH I/CBH II is Case 1 table; CBH I/SEQ ID NO:98 (ENCODED BY SEQ ID NO:97) is Case 2 table and SEQ ID NO:34 (ENCODED BY SEQ ID NO:33)/SEQ ID NO:98 (ENCODED BY SEQ ID NO:97) is the Case 3 table. Xylose concentration was determined by HPLC analysis of the saccharified liquors sampled at 4, 20, 30 and 48 hrs. Percent conversion was calculated by using 113 mM as 100% available xylose in the pretreated solids. Reaction conditions are pH 5.5 and 50° C.

In summary:

| Performance Parameters | Benchmark SPEZYME® enzyme* | Case 1 | Case 2 | Case 3 |
| --- | --- | --- | --- | --- |
| mg active enzyme/g cellulose | 20 | 17.2 | 18.1 | 16.0 |
| % Conversion to glucose | 80 | 76 | 79 | 76 |
| % Conversion to xylose | 65 | 61 | 63 | 62 |
| Time for conversion (hr) | 48 | 48 | 48 | 48 |
| % Solids | 2.5 | 5 | 5 | 5 |

*Performance of SPEZYME® enzyme (15 FPU) on corn stover receiving the 'severe' alkaline pretreatment (15% NH$_4$OH, 170° C., 5 minute residence time) followed by disc-refining (0.010" gap).

Example 11

Optimizing Content of Enzyme Cocktails of the Invention

This example describes the development and integration of a physical/chemical pretreatment of corn stover/fiber with enzymatic hydrolysis of complex polysaccharides to fermentable sugars using polypeptides of the invention. The invention provides methods for developing and evaluating enzymes for hydrolysis and saccharification of pretreated biomass, and enzymes for the hydrolysis and saccharification of pretreated biomass. In one aspect, in practicing the compositions and methods of the invention, overall capital costs and expenses of monomer sugar production can be reduced. The compositions and methods of the invention also provide feedstock for downstream production of fuels and chemicals.

The invention provides enzymes and enzyme mixes ("cocktails") having endoglucanase, cellobiohydrolase and/or β-glucosidase activity for biomass conversion, e.g., for the saccharification of cellulose in pretreated stover. Enzymes of the invention have been demonstrated to have activity in the processing of actual biomass feedstocks, including cellulase- and hemicellulase-comprising compositions, as set forth herein. Selected hemicellulases will be included as resources permit. The invention also uses various analytical and robotic methods to characterize the enzymes of the invention, e.g., to characterize individual and combinations of cellulase and hemicellulase enzymes of the invention on model substrates and pretreated corn stover samples.

Enzymes of the invention include members of glycosyl hydrolase Families 5, 6, 8, 9 and 12 (for discussion of glycosyl hydrolase families see e.g., the CAZy(ModO) website database, as discussed by Coutinho, et al., (1999) Carbohydrate-active enzymes: an integrated database approach. In "*Recent Advances in Carbohydrate Bioengineering*", H. J. Gilbert, et al., eds., The Royal Society of Chemistry, Cambridge, pp. 3-12; and, Coutinho, et al., (1999) The modular structure of cellulases and other carbohydrate-active enzymes: an integrated database approach. In "*Genetics, Biochemistry and Ecology of Cellulose Degradation*", K. Ohmiya, et al., eds., Uni Publishers Co., Tokyo, pp. 15-23). Their discovery process comprised activity screening of 170 endoglucanase genes from environmental sources, including genes from glycosyl hydrolase Families 5, 6, 8, 9 and 12. These genes were subcloned and expressed, and then characterized on the soluble cellulose analog, carboxymethyl cellulose (CMC), and on microcrystalline cellulose (AVICEL® MCC). AVICEL® MCC, which is 50-60% crystalline, was chosen as the model substrate on the premise that performance on AVICEL® MCC would be predictive of performance on pretreated corn stover (PCS).

Figure 64:
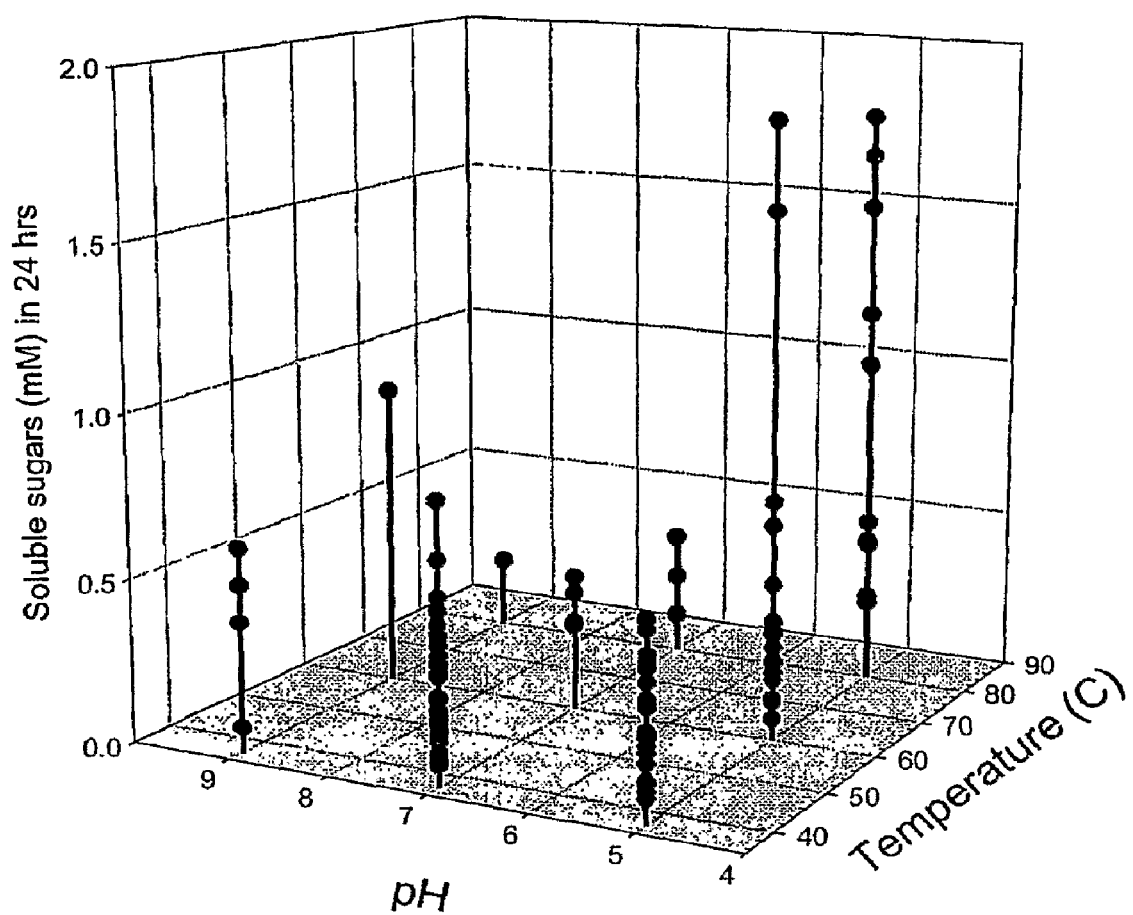
FIG. 64 data summarizes studies of pH and temperature optima of various enzymes on microcrystalline cellulose; as discussed in detail in Example 11, below.

Performance at pH 5, 7 and 9, and 37° C., 60° C. and 80° C. was assayed to define pH and temperature optima for each endoglucanase. Although the final process may not demand thermostable enzymes, a high temperature saccharification may have improved rates of hydrolysis, therefore decreasing enzyme loading and/or residence time requirements. Activity on AVICEL® MCC was assessed by measuring the release of soluble sugars after a 24 hr incubation with enzyme. Ninety-five of the endoglucanases digested AVICEL® MCC to some extent, as illustrated in FIG. 64. Of these, 21 were optimally active at 60° C. and 14 were optimally active at 80° C. FIG. 64 data summarizes studies of pH and temperature optima of 95 enzymes on microcrystalline cellulose AVICEL® MCC (1%). Soluble reducing sugars were measured by a colorimetric assay (BCA, bicinchoninic acid).

Figure 65:
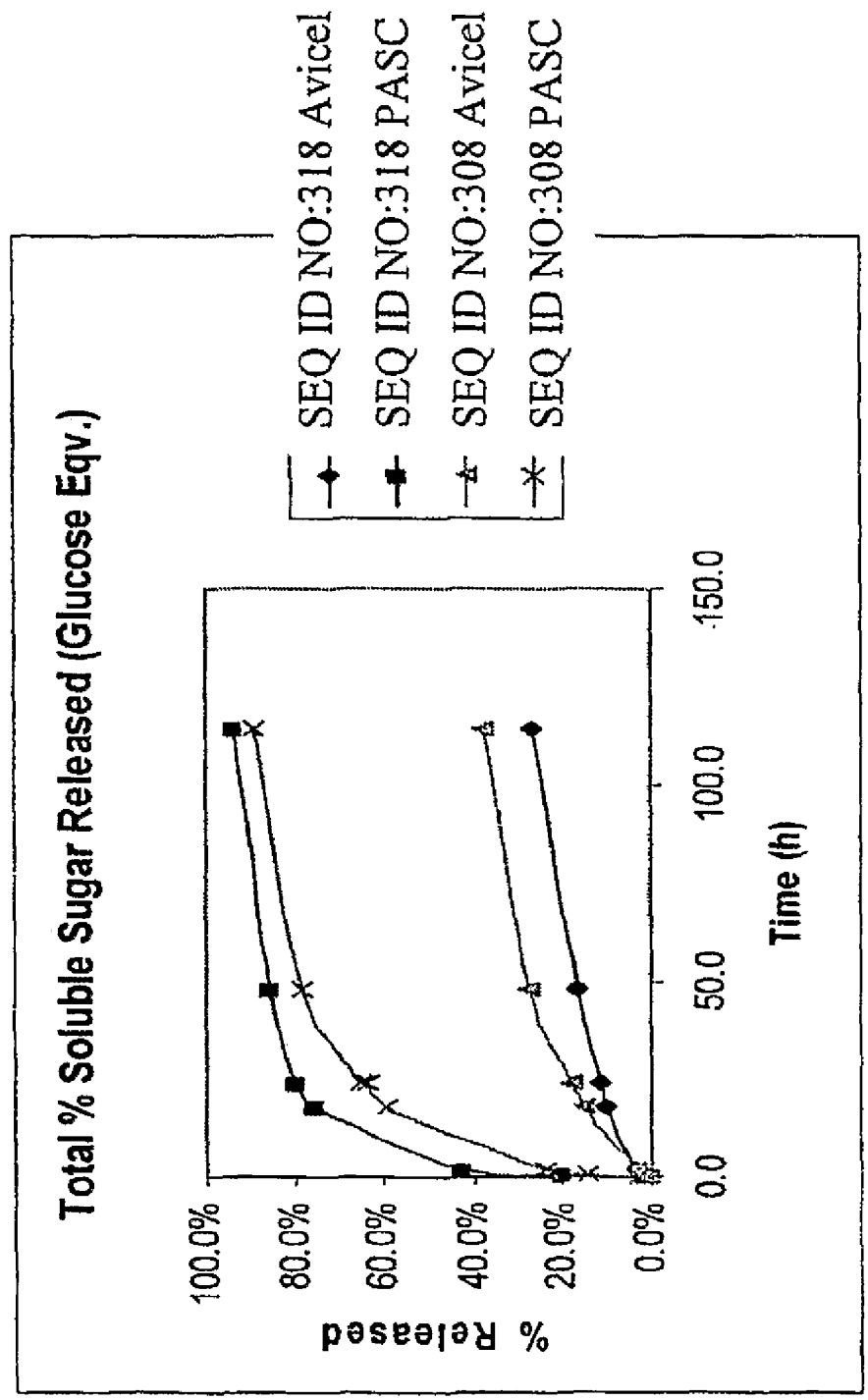
FIG. 65 graphically illustrates data showing the reaction time courses of two exemplary enzymes of the invention with a microcrystalline cellulose and phosphoric acid swollen cellulose; as discussed in detail in Example 11, below.

The highest level of enzyme digestion (hydrolysis) observed was approximately 30% to 40%, with extent of digestion dependent on the conditions of the assay, including time, temperature and substrate concentration. The reaction stalled at this point, without going to completion. A combination of experiments suggested that the stalling was due to limited access to hydrolysable sites in the substrate, rather than to enzyme instability or product inhibition. This was supported by experiments with phosphoric acid—treated AVICEL® MCC (phosphoric acid swollen cellulose, PASC). Phosphoric acid treatment swells and reduces the crystallinity of cellulose, making it more accessible to enzymatic hydrolysis. PASC was 100% hydrolysable by the tested endoglucanases, as illustrated in FIG. 65. FIG. 65 graphically illustrates data showing the reaction time courses of the exemplary enzymes SEQ ID NO:318 (ENCODED BY SEQ ID NO:317) and SEQ ID NO:308 (ENCODED BY SEQ ID NO:307) with 1% (w/v) AVICEL® MCC and phosphoric acid swollen cellulose, PASC. The SEQ ID NO:318 (ENCODED BY SEQ ID NO:317) reaction was run at 80° C. while SEQ ID NO:308 (ENCODED BY SEQ ID NO:307) was run at 60° C. (both at pH 5). Both reaction mixtures contained 1 mg/ml total protein (<5% endoglucanase enzyme). Reaction products (cellobiose and glucose) were determined by HPLC and converted into % conversion based on initial substrate concentration. Glucose equivalent was calculated from G1 and G2×2. Complete conversion is equivalent to approximately 56 mM glucose.

Following the observation that many of the screened endoglucanases (EGs) were active on AVICEL® MCC, the next step was to demonstrate activity on pretreated corn stover samples. Three different pretreated corn stover (PCS) samples were tested: steam PCS, dilute acid PCS and high severity alkaline pretreated corn stover (alkPCS). Not only do these differ in pretreatment method, they also differ in chemical (composition) and physical properties. All endoglucanases were tested for the ability to release soluble sugars from these three PCS samples using an automated, medium throughput screen (described below). The assays were performed at pH 5, 7 and 9, 37° C., or 50° C. with 1% of solids and 0.25 mg/ml total protein (crude cell lysates). Soluble products were analyzed by a reducing sugar assay (BCA). Active hits on alkaline pretreated corn stover (alkPCS) were further confirmed in scaled-up reactions and products were analyzed by HPLC to determine conversion.

Listed below are enzymes tested along with the amount of reducing sugar produced from AVICEL® MCC and whether any reducing sugar was observed from the reaction with the three PCS samples (Y=yes). Included in the table is the amount of conversion for high severity alkaline PCS in 120 hrs. No entry indicates that there was no product formation. There does not seem to be a correlation between performance on AVICEL® MCC and performance on alkPCS. For example, the exemplary SEQ ID NO:106 (ENCODED BY SEQ ID NO:105) performed the best on alkPCS but produced about half the amount of product on AVICEL® MCC as compared to the exemplary SEQ ID NO:434 (ENCODED BY SEQ ID NO:433).

Figure 66:
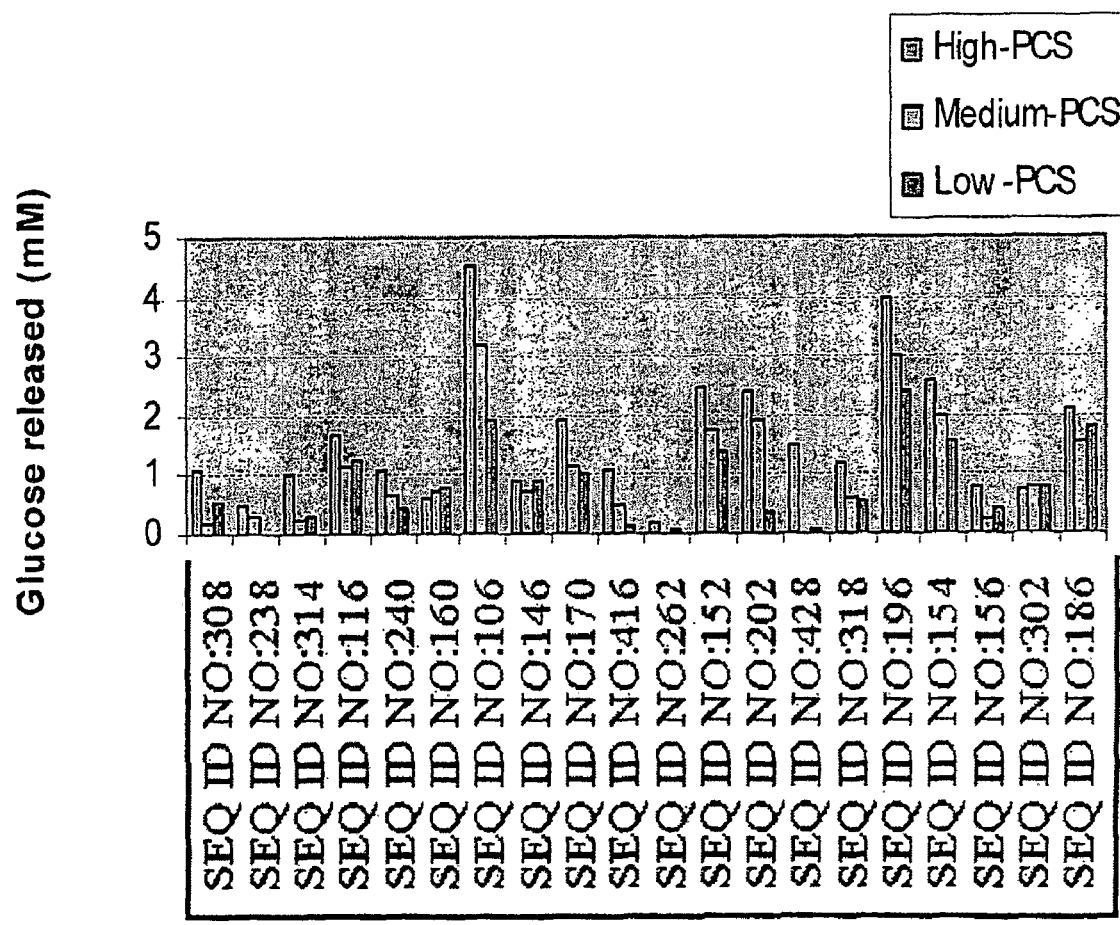
FIG. 66 graphically illustrates data of studies showing glucose equivalent release from high, medium and low severity alkPCS by various endoglucanases (EGs) of the invention; as discussed in detail in Example 11, below.

Furthermore, several clones were active on alkPCS but inactive on AVICEL® MCC (see SEQ ID NO:202 (ENCODED BY SEQ ID NO:201), 10848 and 13626). Twenty-one enzymes have activity on alkPCS. These same enzymes were tested on "medium" and "low" severity alkPCS. FIG. 66 compares the amount of glucose released from these three samples under identical reaction conditions (1 mg/ml protein load, 2.2% solids, 5 ml). Complete digestion would result in approx. 56 mM glucose. FIG. 66 graphically illustrates data of studies showing glucose equivalent release from high, medium and low severity alkPCS by various endoglucanases (EGs) of the invention after 48 hr. Reaction conditions were 37°, 50° or 80° C. and pH 5 or 7, depending on the optimum of the individual enzyme.

Figure 67:
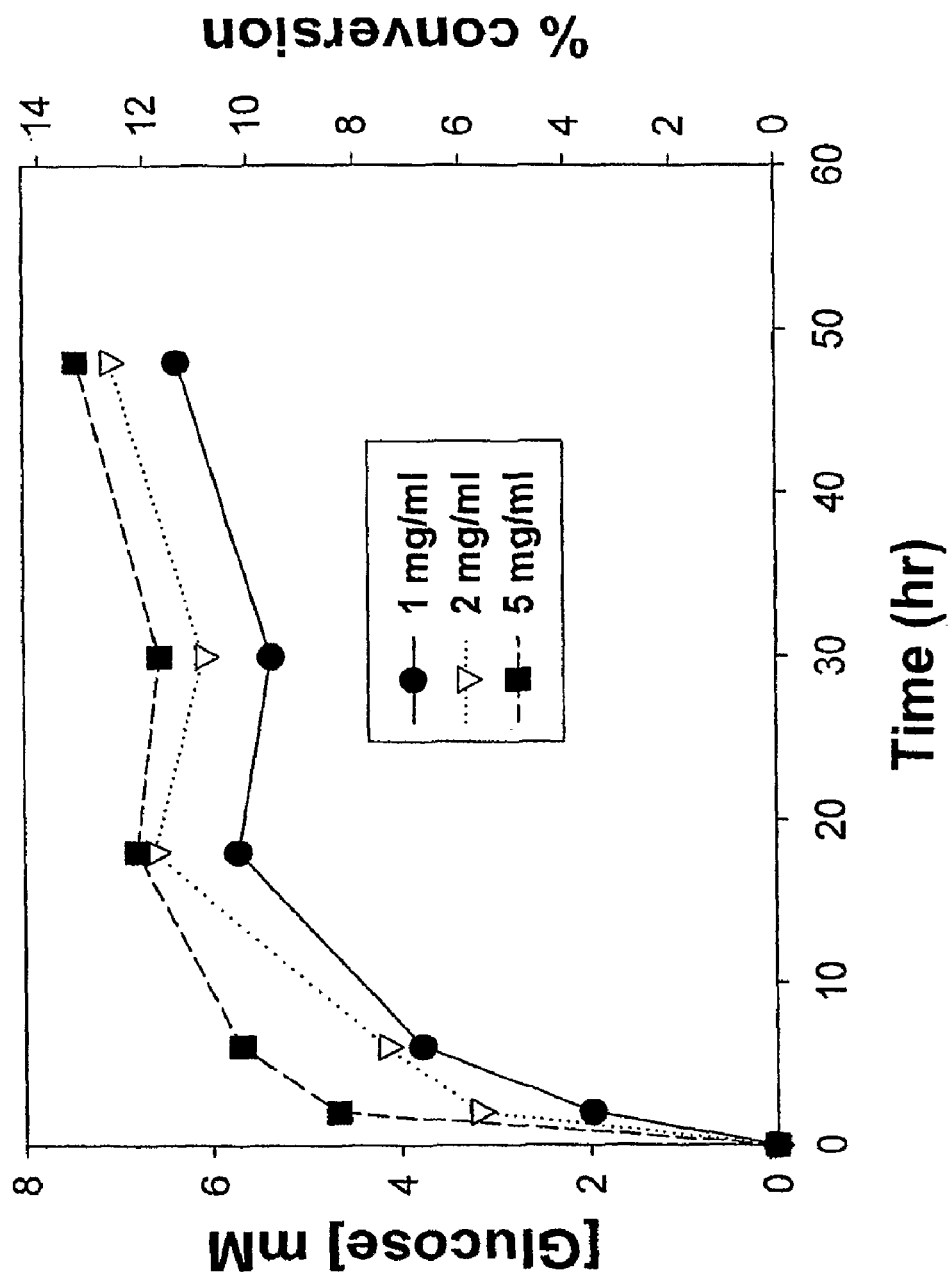
FIG. 67 graphically illustrates data of studies showing the dose dependence of an exemplary enzyme of the invention; as discussed in detail in Example 11, below.

The exemplary SEQ ID NO:106 (ENCODED BY SEQ ID NO:105) performed the best on the three alkaline pretreated corn stover samples. Time courses revealed that product release saturated between 12% to 14% conversion. This observation is very similar to activity on AVICEL® MCC (see FIG. 64). Dose dependence of SEQ ID NO:106 (ENCODED BY SEQ ID NO:105), as illustrated in FIG. 67, showed that the rate of glucose release increased with increased concentration of enzyme, however extent was not significantly affected. Limited conversion that is unaffected by increased enzyme loading suggests that there are limited accessible sites on cellulose in alkPCS and is not an indication of enzyme instability. Subsequent tasks (mainly Task 2.5, enzyme cocktails) are designed to address this issue. FIG. 67 graphically illustrates data of studies showing the dose dependence of the exemplary SEQ ID NO:106 (ENCODED BY SEQ ID NO:105) (crude *E. coli* lysate). Conditions were 50° C., pH 5, 2.2% solids (high severity alkPCS).

Development of Medium Throughput Screening Methods and Analytical Tools

Figure 68:
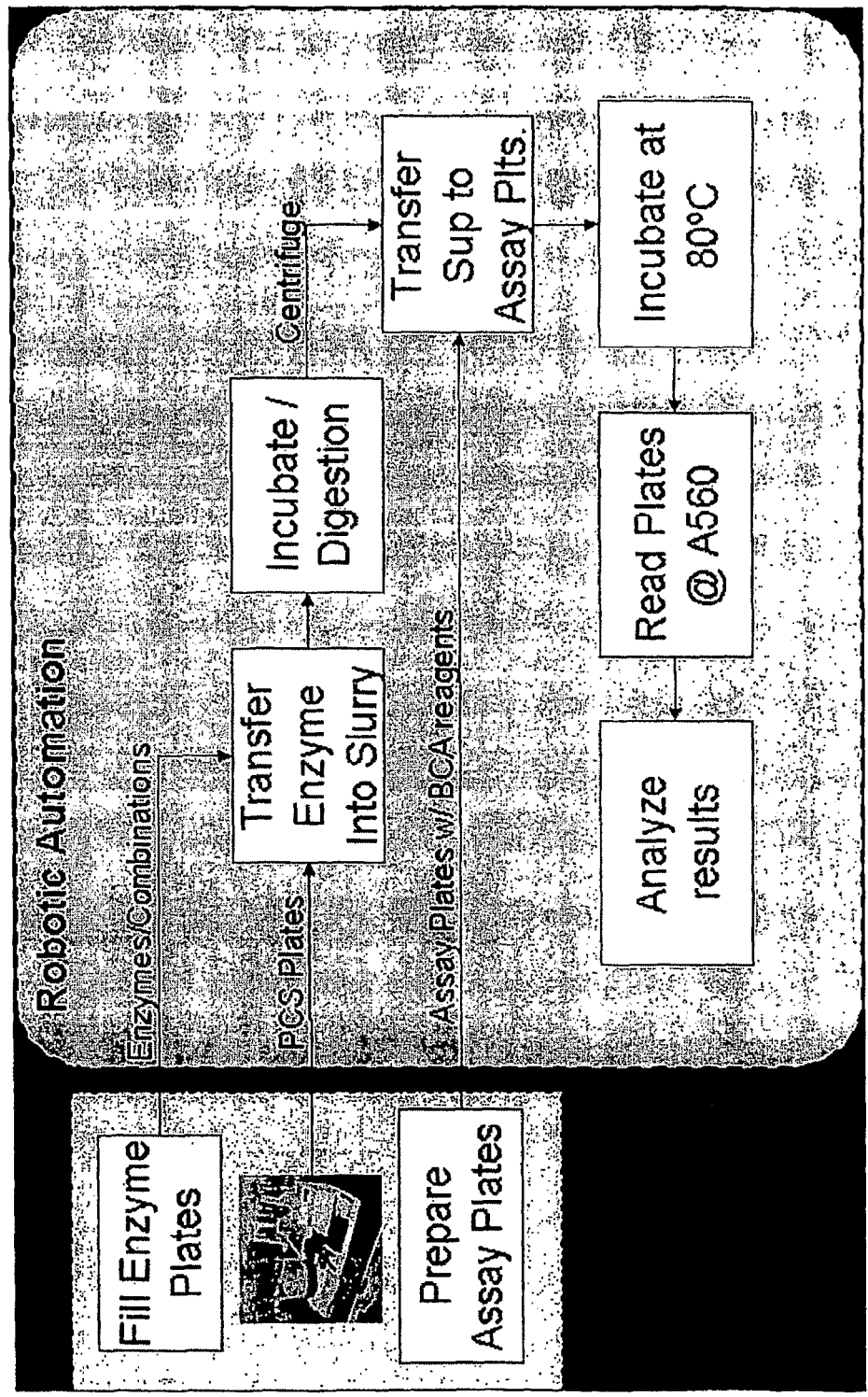
FIG. 68 illustrates a schematic of an exemplary automated system of the invention developed to screen large numbers of enzymes and substrates; as discussed in detail in Example 11, below.

Robotic assays. The invention provides automated methods to assess performance (e.g., activity) of enzymes (e.g., to determine if a polypeptide is within the scope of the invention), including testing activity of the enzymes of the invention. These methods include dispensing solid substrates and enzymes into microtiter plates, incubation at several conditions and analyzing for products at regular time intervals, as illustrated, for example, in FIG. 68. FIG. 68 illustrates a schematic of an exemplary automated system of the invention developed to screen large numbers of enzymes and substrates.

Figure 69:
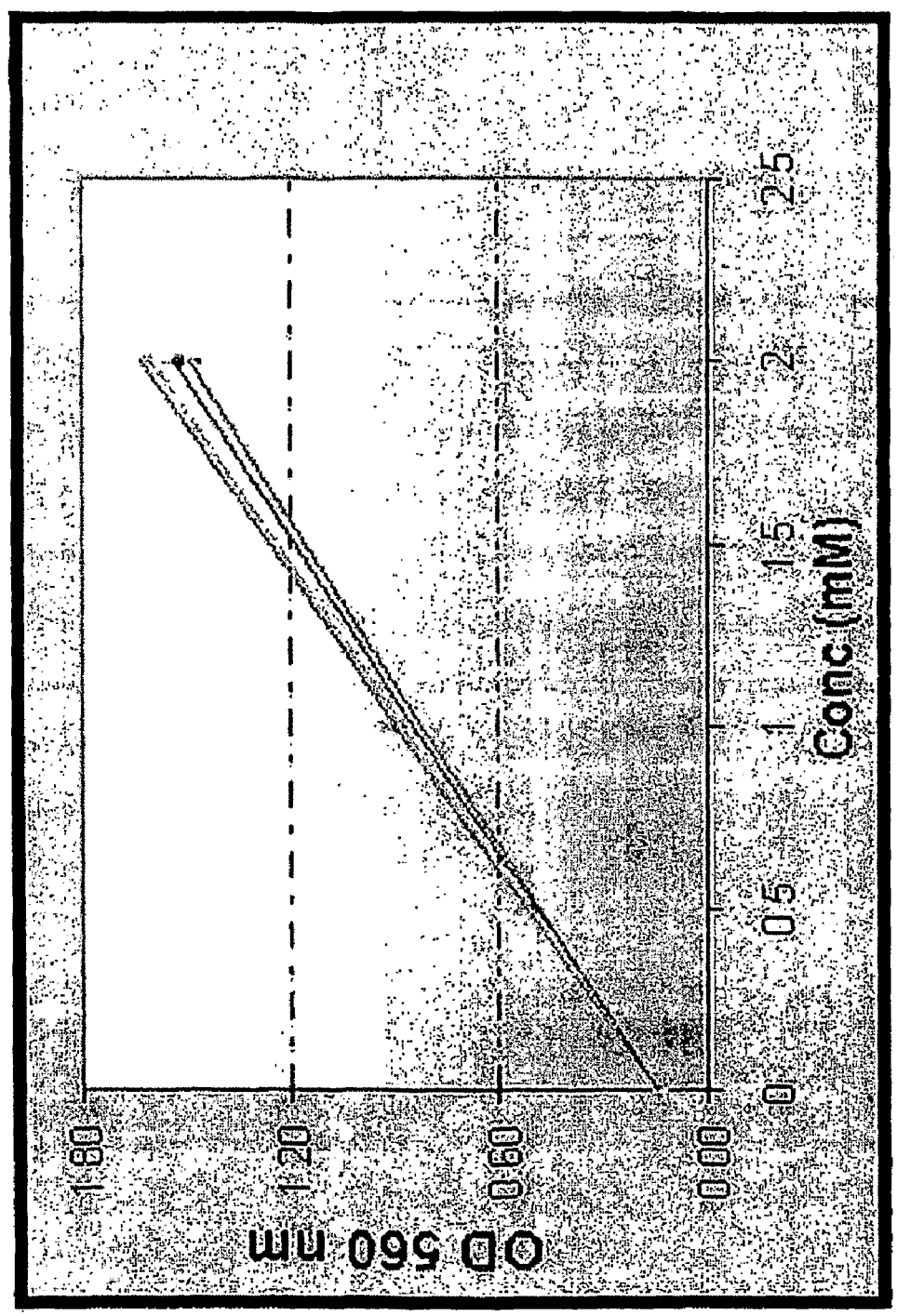
FIG. 69 graphically illustrates data of studies showing product detection methods using an exemplary assay of the invention comprising use of a "BCA" (bicinchoninic acid) reducing sugar assay; as discussed in detail in Example 11, below.
Figure 70:
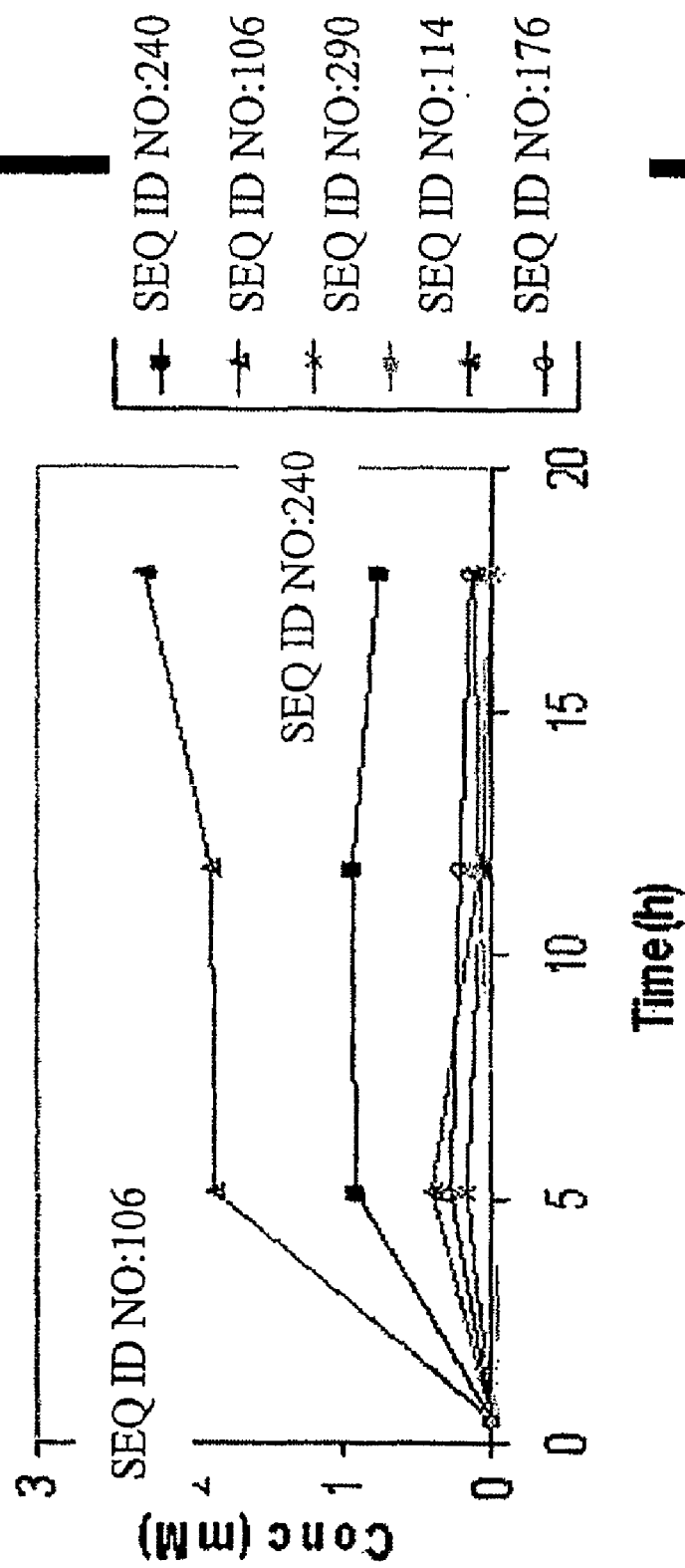
FIG. 70 graphically illustrates data of studies showing the results of robotic methods of the invention wherein thousands of assay reactions per day were carried out, the assay comprising use of alkaline PCS and a series of endoglucanases of the invention; as discussed in detail in Example 11, below.

A variety of product detection methods were tested and it was determined that the exemplary assay of the invention comprising use of a "BCA" (bicinchoninic acid) reducing sugar assay was the most robust due to its sensitivity and broad substrate specificity, as illustrated in FIG. 69. Development of these methods allowed carrying out of thousands of reactions per day. An exemplary assay using alkaline PCS and a series of endoglucanases is shown in FIG. 70. FIG. 69 illustrates standard curves of glucose on the automated system. Glucose standards were removed from microtiter plates at defined times, mixed with the BCA reagent and absorbance measured. FIG. 70 illustrates testing of six enzymes of the invention on high severity alkPCS at pH 5 and 50° C. The standard curves shown in (A) were used to convert absorbance into sugar concentration.

Figure 71:
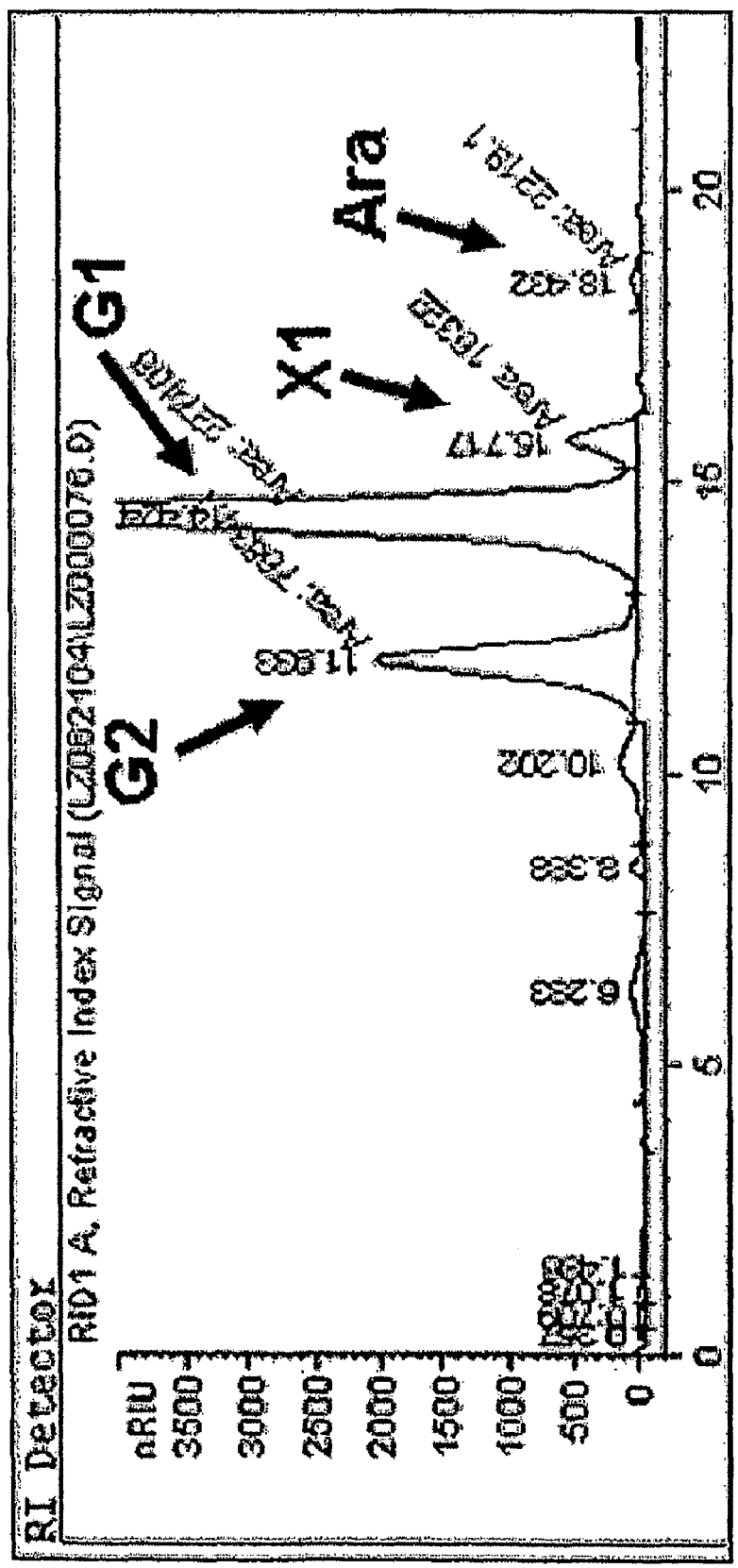
FIG. 71 illustrates data from an HPLC separation of sugar monomers following enzymatic digestion of alkPCS; as discussed in detail in Example 11, below.

High Pressure Liquid Chromatography and Capillary Electrophoresis:

Once exemplary enzymes were identified using the high throughput systems, larger scale reactions (5 mL) were performed to validate performance and accurately measure product concentrations. Certain analytical tools had to be developed in order to discriminate between the various reaction products. These tools included high pressure liquid chromatography (HPLC, RI or ELSD detection) and capillary electrophoresis (CE). Each has advantages and disadvantages, and currently HPLC-RI has been the workhorse method but the other two are used under special circumstances. An example of HPLC-RI separation and detection of various sugars is shown in FIG. 71. FIG. 71 illustrates data from an HPLC separation of sugar monomers following enzymatic digestion of alkPCS. G2: cellobiose, G1: glucose, X1: xylose and Ara: arabinose.

Figure 72:
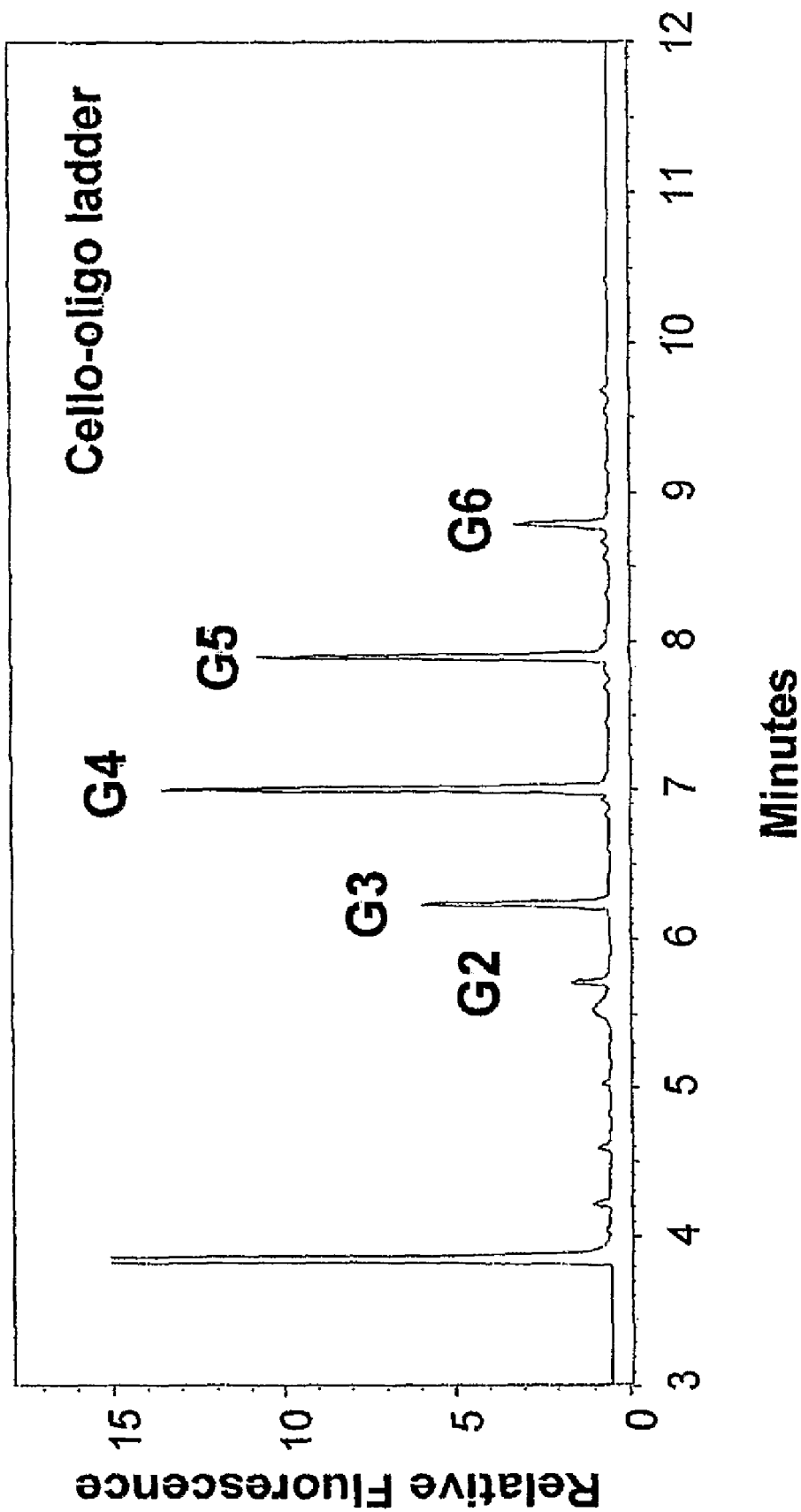
FIG. 72 summarizes the capillary electrophoresis separation of cello-oligosaccharides from cellobiose to cellohexaose; as discussed in detail in Example 1, below.

Capillary electrophoresis (CE), a very fast and sensitive method, is used in methods of the invention to monitor product release, as illustrated in FIG. 72. Prior to capillary electrophoresis the reaction products were labeled with the fluorophore 1-aminopyrene-3,6,8-trisulfonate (APTS). Labeling with this compound resulted in sub-micromolar detection of sugars. There was baseline separation between the cello-oligosaccharides which allowed for reaction profiling and quantitation of products. FIG. 72 summarizes the capillary electrophoresis separation of cello-oligosaccharides from cellobiose (G2) to cellohexaose (G6). Prior to electrophoresis the sugars were labeled with APTS.

Cellobiohydrolase and β-Glucosidase Discovery

High throughput activity-based screening methods were developed for β-glucosidase and cellobiohydrolase discovery. These screens utilized model chromophoric substrates, specifically resorufine-β-glucopyranoside (A) for the β-glucosidases and either 4-methylumbelliferone-cellobioside (B) or 4-methyl-umbelliferone-lactoside (C) for the cellobiohydrolases.

Close to 100 β-glucosidase genes were isolated during the discovery phase of the program. Bioinformatic analysis helped identify the most likely open reading frame for each gene. The genes were then subcloned into overexpression vectors for more detailed biochemical analysis. Sequence analysis showed that these β-glucosidase enzymes of the invention were almost equally distributed between the Family 1 and 3 glycosyl hydrolases; enzymes belong to either Family 1 ("GH1") or Family 3 ("GH3") of the glycosyl hydrolase superfamily.

Figure 73:
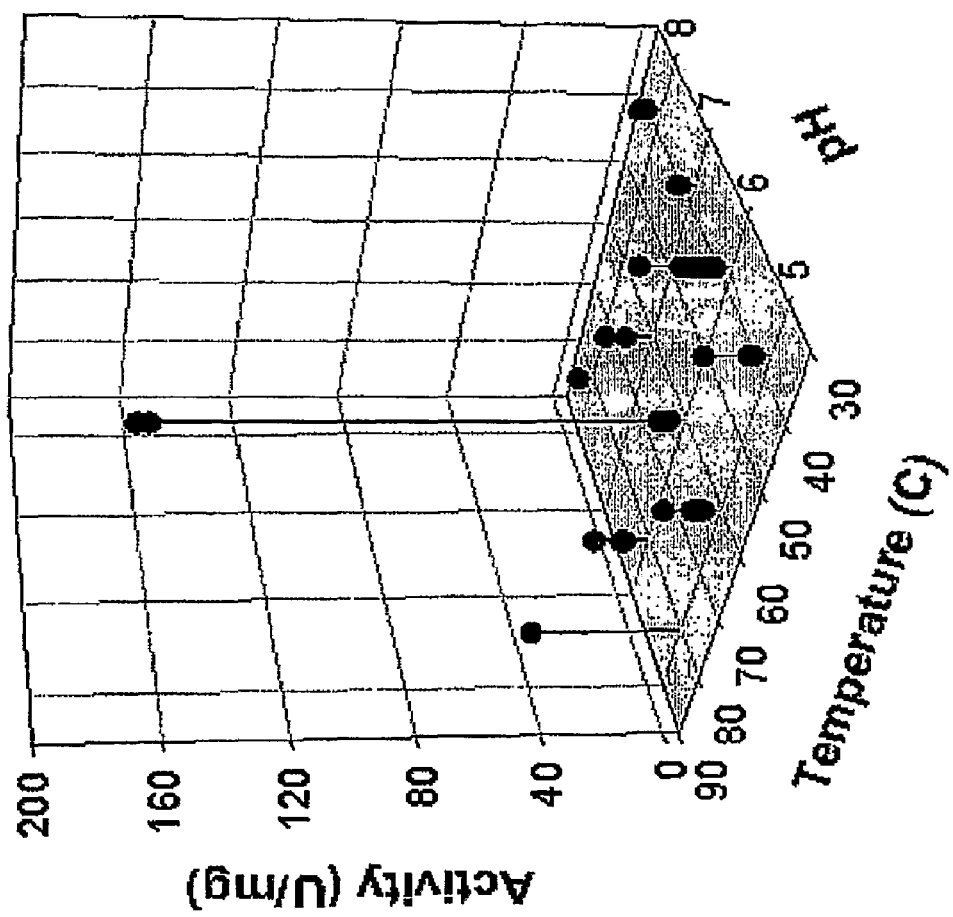
FIG. 73 summarizes the capillary electrophoresis separation of cello-oligosaccharides from cellobiose to cellohexaose; as discussed in detail in Example 11, below.

Biochemical characterization of these exemplary β-glucosidases involved determination of pH and temperature optima on a model chromophoric substrate, pNP-β-glucopyranoside (pNP-β-gluc). Crude, cell-free extracts were used in each assay and activity is reported as units/mg total protein. Activity measured in this manner is a reflection of both specific activity and gene expression. 60 out of 93 subcloned β-glucosidases were assayed on pNP-β-gluc, as illustrated in FIG. 73. Fifty-one of the enzymes had measurable activity. FIG. 73 graphically illustrated data showing pH and temperature optima for 51 active β-glucosidases of the invention. Rates of hydrolysis of pNP-β-glucopyranoside normalized to total protein in a crude E. coli lysate.

Figure 74:
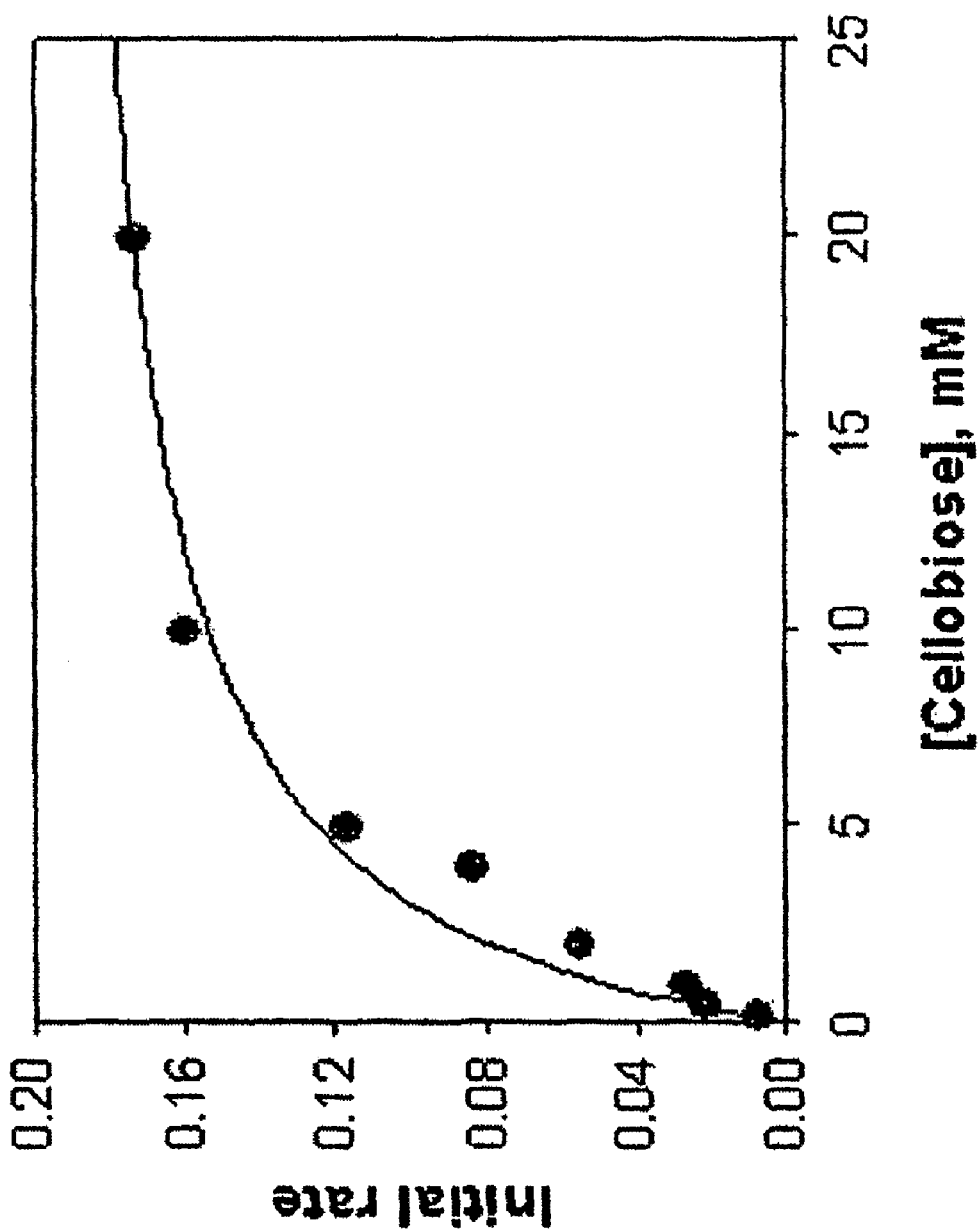
FIG. 74 graphically illustrates a Michaelis-Menten plot of activity of an exemplary enzyme with the substrate cellobiose; as discussed in detail in Example 11, below.

Using this assay, three exemplary enzymes of the invention, SEQ ID NO:264 (ENCODED BY SEQ ID NO:263) (44 U/mg at pH 5 and 80° C.), SEQ ID NO:94 (ENCODED BY SEQ ID NO:93) (164 U/mg at pH 6 and 60° C.) and SEQ ID NO:388 (ENCODED BY SEQ ID NO:387) (160 U/mg at pH 6 and 60° C.), stand out from the rest. These 3 were chosen for more detailed kinetic analysis on cellobiose and cellohexaose. Using this assay, the exemplary SEQ ID NO:94 (ENCODED BY SEQ ID NO:93) and SEQ ID NO:388 (encoded by SEQ ID NO:387) both were significantly more active on cellohexaose than on cellobiose, while SEQ ID NO:264 (ENCODED BY SEQ ID NO:263) had almost equivalent activity on these two substrates. Since in one aspect cellobiose is the substrate in a bioconversion process of the invention, the kinetics of the exemplary SEQ ID NO:264 (ENCODED BY SEQ ID NO:263) was analyzed on this substrate FIG. 74 shows that the exemplary SEQ ID NO:264 (ENCODED BY SEQ ID NO:263) has a $K_m$ of ~2.5 mM cellobiose without any sign of substrate inhibition up to 20 mM cellobiose. FIG. 74 graphically illustrates a Michaelis-Menten plot of activity of the exemplary SEQ ID NO:264 (ENCODED BY SEQ ID NO:263) with the substrate cellobiose. The line represents a fit to the Michaelis—Menten equation with a $K_M$ of approximately 2.5 mM.

In addition to activity-based screening utilizing environmental DNA libraries, sequence-based screening of fungal strains isolated from high throughput culturing (HTC) was undertaken. Approximately 150 unique fungal strains isolated using high-throughput cultivation (HTC) technology; these strains were screened for the ability to consume AVICEL MCC, steam pretreated corn stover and dilute acid pretreated corn stover. The enrichment was set up in such a way that the sole source of carbon was the cellulosic substrate; hence growth was dependent upon the ability of the fungus to digest the polymeric substrates to metabolizeable sugars. Trichoderma reesei RutC30 (from ATCC) was used as the benchmark. Seventeen fungal strains outperformed T. reesei by consuming PCS in a shorter period of time. Genomic DNA and cDNA was isolated from the 10 best strains to be used as sources for novel cellobiohydrolase genes.

(CBH II) and Family 7 (CBH I) Cellobiohydrolases.

PCR of genomic DNA and cDNA using the degenerate oligonucleotide primers resulted in the isolation of 59 partial unique cellobiohydrolase genes, 41 family 7 and 18 family 6. From the 59 partial genes 55 were recovered as full length. A partial phylogenetic analysis of the catalytic domains from these enzymes showed that there are a number of enzymes that are quite dissimilar to the known cellobiohydrolases.

Figure 75:
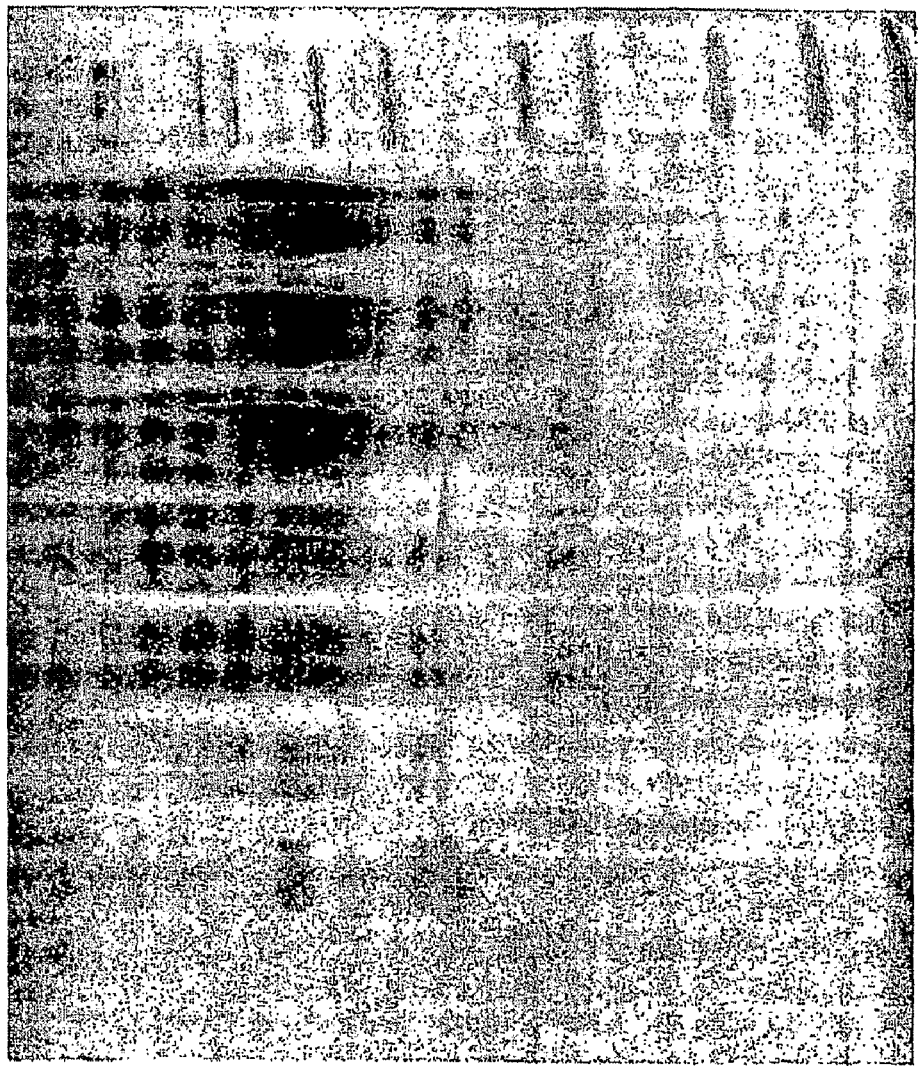
FIG. 75 illustrates an SDS-PAGE analysis, and FIG. 76 graphically illustrates activity assays, of culture broths from a 30 L fermentor to show accumulation of protein and activity; as discussed in detail in Example 11, below.
Figure 76:
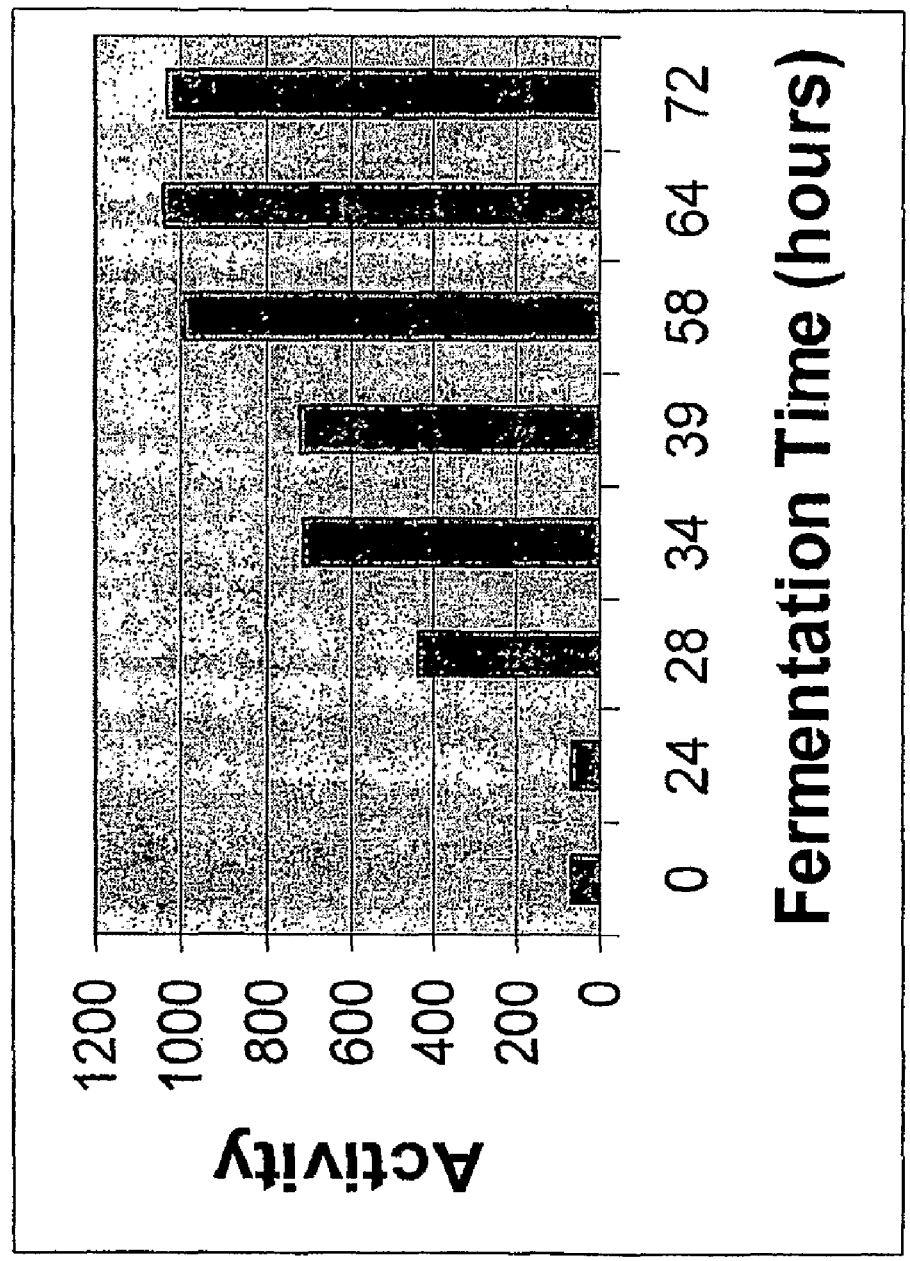

The invention provides methods for expressing fungal cellobiohydrolase, including heterologous expression of these genes in fungal systems. Eukaryotic expression systems used to practice the invention include: (1) a yeast, e.g., a *Pichia*, e.g. *Pichia pastoris*; and/or, (2) a fungus, e.g., a *Cochliobolus*, e.g., *Cochliobolus heterostrophus*. *Pichia* expression results in secretion into the culture broth; systems are commercially available. 37 CBH genes were subcloned into *Pichia* vectors. Activity was detected in the exemplary SEQ ID NO:450 (encoded, e.g., by SEQ ID NO:449) enzyme (Family 6 homolog) in both small (microtiter plate) and large (30 L fermentor) scale. SDS-PAGE analysis (as illustrated in FIG. 75) and activity assays (FIG. 76) of culture broths from the 30 L fermentor showed substantial accumulation of protein and activity. In one aspect, these genes, including the coding sequence for the exemplary SEQ ID NO:450 (encoded, e.g., by SEQ ID NO:449) enzyme, are subcloned into the *Cochliobolus* expression system. For the SDS-PAGE (FIG. 75) and activity assays (FIG. 76) on samples removed from a fermentor of SEQ ID NO:450 (encoded, e.g., by SEQ ID NO:449), activity was measured on PASC.

Digestion of PCS (Enzyme Cocktails)

As discussed above, the invention provides various mixtures, or "cocktails", of enzymes for biomass conversion, including cocktails comprising enzymes of the invention (in whole or in part). Combinations of the invention, including enzymes of the invention, e.g., cellulases and hemicellulases, can result in both synergistic and additive effects and yield higher levels of conversion than possible with single enzymes.

Figure 77B:
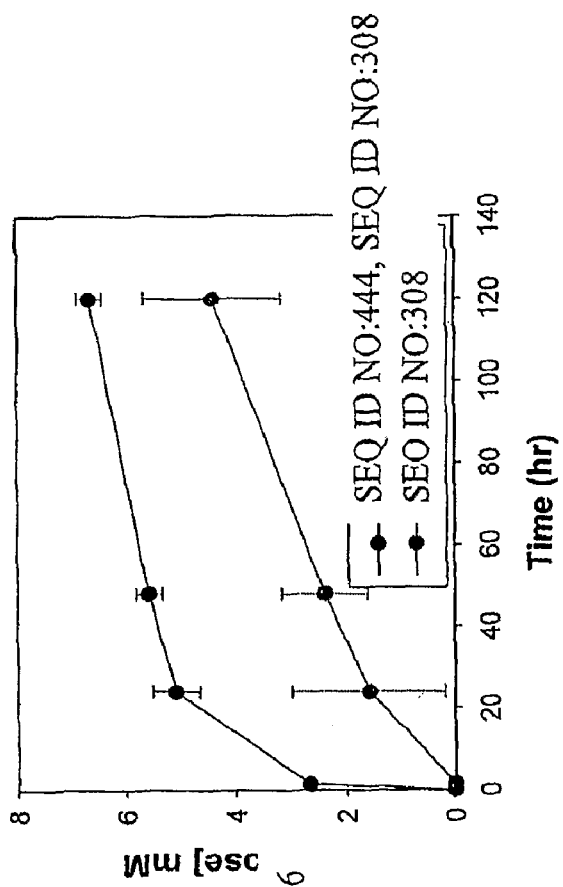
FIG. 77 graphically illustrates data showing the effect of cellulose hydrolysis by combining an exemplary xylanase of the invention with an exemplary endoglucanase of the invention (FIG. 77A) or (FIG. 77B); as discussed in detail in Example 11, below.
Figure 77A:
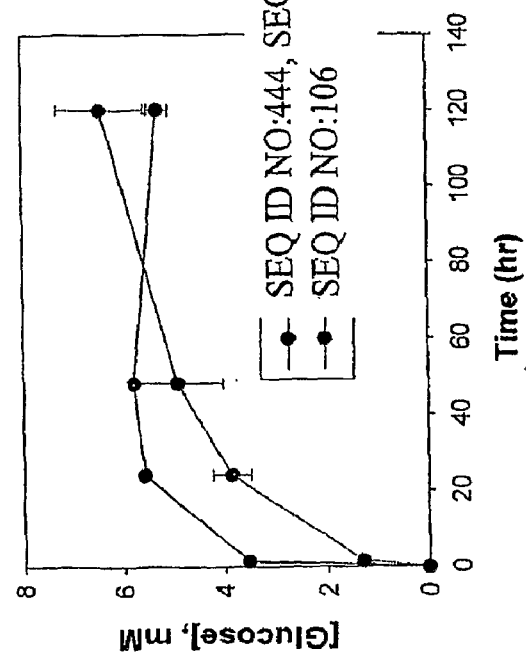

In one aspect of the methods of the invention, the hemicellulose fraction of a biomass is removed because removal of the hemicellulose fraction reveals previously inaccessible cellulose that would become digestible. The exemplary endoglucanases SEQ ID NO:106 (encoded, e.g., by SEQ ID NO:105) or SEQ ID NO:308 (encoded, e.g., by SEQ ID NO:307) were combined with the exemplary xylanase SEQ ID NO:444 (encoded, e.g., by SEQ ID NO:443) (individual activity of this enzyme is presented elsewhere herein). FIG. 77 shows that the presence of the exemplary SEQ ID NO:444 (encoded, e.g., by SEQ ID NO:443) in the reaction mix enhances the rate of glucose release by SEQ ID NO:106 (encoded, e.g., by SEQ ID NO:105) but has little effect on the overall extent. On the other hand, the exemplary SEQ ID NO:444 (encoded, e.g., by SEQ ID NO:443) enhances both the rate and extent of glucose release by the exemplary SEQ ID NO:308 (encoded, e.g., by SEQ ID NO:307) (SEQ ID NO:444 (encoded, e.g., by SEQ ID NO:443) alone did not result in any glucose release). In this aspect, the exemplary SEQ ID NO:444 (encoded, e.g., by SEQ ID NO:443) makes the substrate more accessible to these two endoglucanases. Interestingly, at least in these assays, the exemplary SEQ ID NO:106 (encoded, e.g., by SEQ ID NO:105) has some amount of xylanase activity whereas SEQ ID NO:308 (encoded, e.g., by SEQ ID NO:307) did not, perhaps explaining the difference in performance between the two enzymes in these studies. Another observation is that in both cases the extent saturates in the 6-7 mM range of glucose (approximately 12% conversion), suggesting that this is the maximum level of conversion attainable by an endoglucanase alone. FIG. 77 graphically illustrates data showing the effect of cellulose hydrolysis by combining the exemplary xylanase SEQ ID NO:444 (encoded, e.g., by SEQ ID NO:443) with the exemplary endoglucanase SEQ ID NO:106 (encoded, e.g., by SEQ ID NO:105) (FIG. 77A) or SEQ ID NO:308 (encoded, e.g., by SEQ ID NO:307) (FIG. 77B). The substrate was high severity alkPCS (2.2% solids) at 50° C., pH 5. Enzyme concentrations were 1 ml/ml each.

Figure 78A:
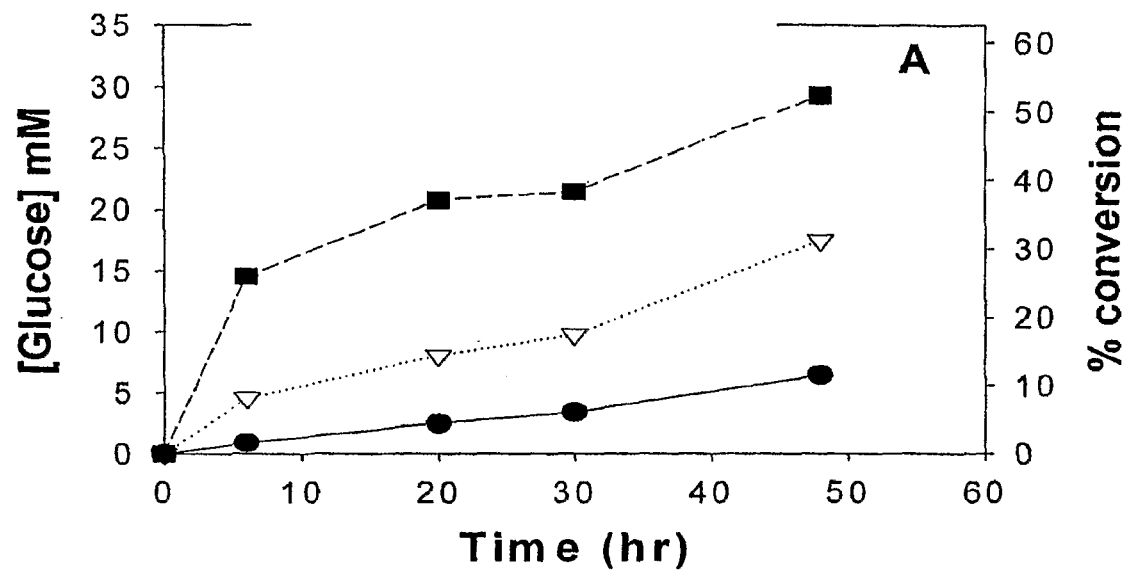
FIG. 78 graphically illustrates data showing the effect of cellulose hydrolysis using an enzyme mixture of the invention: made by combining an exemplary xylanase of the invention, an exemplary endoglucanase of the invention, an exemplary β-glucosidase of the invention and a CBHI (FIG. 78A) or a CBHII (FIG. 78B).
Figure 78B:
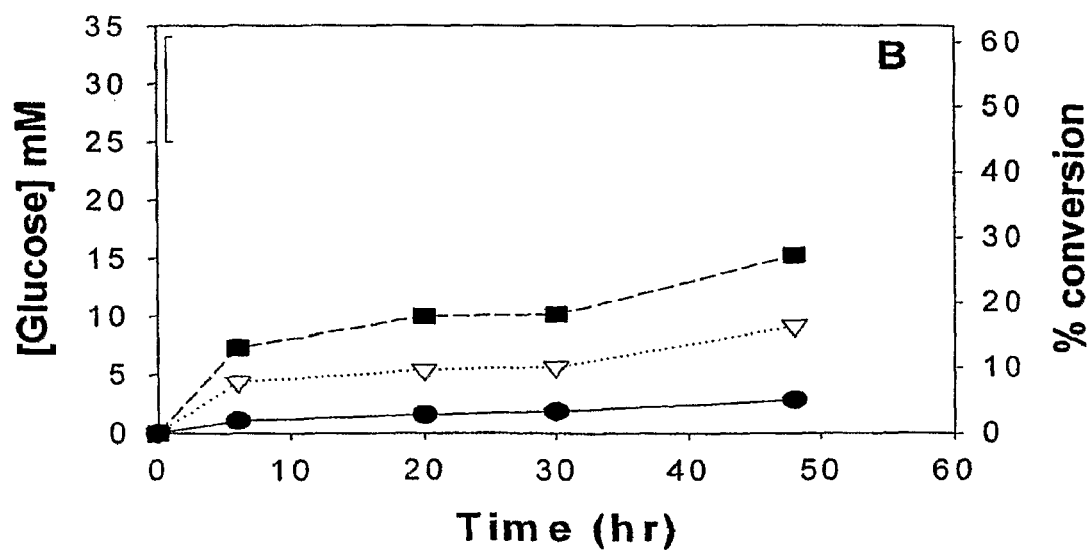

Combinatorial work was extended to include other enzyme types, specifically the exemplary β-glucosidase SEQ ID NO:264 (encoded, e.g., by SEQ ID NO:263) and one or more cellobiohydrolases (*T. reesei* CBHI and II). FIGS. 78A and 78B shows that the cellobiohydrases were able to enhance the digestion of alkPCS, with CBHI being more effective than CBHII. This combination of enzymes reached approximately 55% conversion, compare with approximately 12% with the exemplary SEQ ID NO:106 (encoded, e.g., by SEQ ID NO:105) alone. Further inspection of the data shows that all enzymes were required to reach this high level of conversion and that the effect was synergistic rather than additive. Thus, the invention provides an enzyme cocktail comprising the exemplary β-glucosidase SEQ ID NO:264 (encoded, e.g., by SEQ ID NO:263) and one or more cellobiohydrolase(s).

FIG. 78 graphically illustrates data showing the effect of cellulose hydrolysis using an enzyme mixture of the invention: made by combining the exemplary xylanase of the invention SEQ ID NO:444 (encoded, e.g., by SEQ ID NO:443), the exemplary endoglucanase of the invention SEQ ID NO:106 (encoded, e.g., by SEQ ID NO:105), the exemplary β-glucosidase of the invention SEQ ID NO:264 (encoded, e.g., by SEQ ID NO:263), and CBHI (FIG. 78A) or CBHII (FIG. 78B). The substrate was high severity alkPCS (2.2% solids) at 50° C., pH 5. Enzyme concentrations were 1 mg/ml each for SEQ ID NO:444 (encoded, e.g., by SEQ ID NO:443), SEQ ID NO:106 (encoded, e.g., by SEQ ID NO:105) and SEQ ID NO:264 (encoded, e.g., by SEQ ID NO:263), and 0.05 mg/mL each for CBH I and CBH II.

Hemicellulase Characterization

Figure 79:
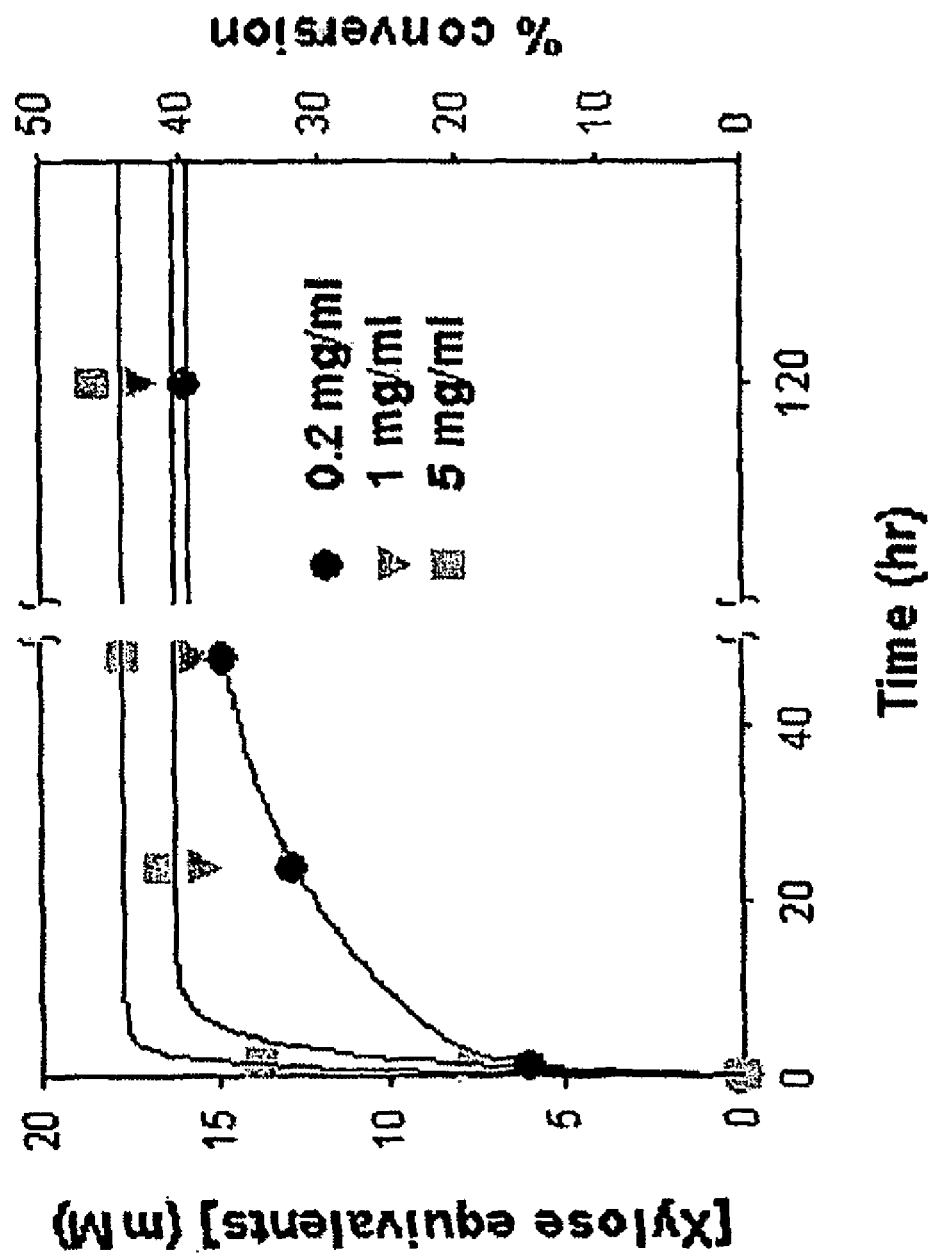
FIG. 79 graphically illustrates data showing the time courses for three different enzyme loadings with xylan as a substrate, and monitoring xylose and xylobiose as products by HPLC-RI and converting data to "xylose equivalents"; as discussed in detail in Example 11, below.

The invention also provides polypeptides having hemicellulase activity, and methods of using them, e.g., in processing biomass. Initial discovery comprised surveying a number of hemicellulases in order to: (1) release hemicellulose sugar monomers and (2) enhance the activity of the cellulases by uncovering additional active sites. Over 200 xylanases, including Family 10 and 11, were tested. Based on characterization data two enzymes of the invention, SEQ ID NO:444 (encoded, e.g., by SEQ ID NO:443) and SEQ ID NO:100 (encoded, e.g., by SEQ ID NO:99), were chosen for further characterization on hemicellulose processing. The exemplary SEQ ID NO:444 (encoded, e.g., by SEQ ID NO:443) was assayed for the ability to digest the hemicellulose component of high severity alkPCS. FIG. 79 shows the time courses for three different enzyme loadings (0.2, 1 and 5 mg/ml based on total protein in a crude lysate) using 2.2% solids (approx. 0.6% xylan) at 50° C. and pH 5 in 5 ml. Products (xylose and xylobiose) were monitored by HPLC-RI and the data were converted to "xylose equivalents" by multiplying xylobiose concentrations by 2. There is an initial very fast (<6 hrs) release of xylose and xylobiose and then an extended slower phase reaching saturation at between 40 and 50% conversion. Higher enzyme loading resulted in increased rate of conversion but no additional increase in extent. Preliminary experiments suggested that saturation was not due to enzyme instability but more than likely due to substrate inaccessibility. It is possible that limited reactivity is due to branch points in hemicellulose that the exemplary SEQ ID NO:444 (encoded, e.g., by SEQ ID NO:443) can not digest through. Thus, in one aspect, additional enzymes are added in this process such that arabinose and glucuronic acid groups are cleaved (the invention providing enzyme cocktails comprising the exemplary SEQ ID NO:444 (encoded, e.g., by SEQ ID NO:443) and arabinose- and glucuronic acid group-cleaving enzymes)Reactions of the exemplary SEQ ID NO:444 (encoded, e.g., by SEQ ID NO:443) with medium and low severity alkPCS.

showed a similar pattern with approximately the same amount of product release. In one aspect, provides enzyme cocktails comprising the exemplary SEQ ID NO:444 (encoded, e.g., by SEQ ID NO:443) and endoglucanase, β-glucosidase and/or cellobiohydrolase enzymes; see discussion, above.

The following chart summarizes activity of exemplary enzymes of the invention (including the concentration of sugar, "[sugar]", from AVICEL® MCC in a 24 hr reaction, mM, activity on pretreated corn stover (PCS), acid pretreated corn stover (PCS), and High severity alk-PCS (% conversion)):

| Enzyme | [sugar] from AVICEL® MCC in 24 hr reaction, mM | Steam PCS | acid PCS | High severity alk-PCS (% conversion) |
|---|---|---|---|---|
| SEQ ID NO: 434 (encoded, e.g., by SEQ ID NO: 433) | 1.79 | | | |
| SEQ ID NO: 156 (encoded, e.g., by SEQ ID NO: 155) | 1.67 | | | Y (1.5) |
| SEQ ID NO: 308 (encoded, e.g., by SEQ ID NO: 307) | 1.59 | | Y | Y (2.3) |
| SEQ ID NO: 318 (encoded, e.g., by SEQ ID NO: 317) | 1.51 | Y | Y | Y (3.1) |
| SEQ ID NO: 372 (encoded, e.g., by SEQ ID NO: 371) | 1.18 | | | |
| SEQ ID NO: 314 (encoded, e.g., by SEQ ID NO: 313) | 1.02 | | | Y (1.4) |
| SEQ ID NO: 302 (encoded, e.g., by SEQ ID NO: 301) | 0.94 | | | Y (1.9) |
| SEQ ID NO: 106 (encoded, e.g., by SEQ ID NO: 105) | 0.84 | Y | Y | Y (8.8) |
| SEQ ID NO: 120 (encoded, e.g., by SEQ ID NO: 119) | 0.83 | Y | | |
| SEQ ID NO: 126 (encoded, e.g., by SEQ ID NO: 125) | 0.73 | | Y | |
| SEQ ID NO: 110 (encoded, e.g., by SEQ ID NO: 109) | 0.67 | | | |
| SEQ ID NO: 146 (ENCODED BY SEQ ID NO: 145) | 0.66 | | Y | Y (2.3) |
| SEQ ID NO: 354 (ENCODED BY SEQ ID NO: 353) | 0.62 | | | |
| SEQ ID NO: 160 (ENCODED BY SEQ ID NO: 159) | 0.59 | | | Y (5.5) |
| SEQ ID NO: 176 (ENCODED BY SEQ ID NO: 175) | 0.56 | | | |
| SEQ ID NO: 236 (ENCODED BY SEQ ID NO: 235) | 0.56 | | | |
| SEQ ID NO: 246 (ENCODED BY SEQ ID NO: 245) | 0.52 | | | |
| SEQ ID NO: 216 (ENCODED BY SEQ ID NO: 215) | 0.51 | | | |
| SEQ ID NO: 296 (ENCODED BY SEQ ID NO: 295) | 0.51 | | | |
| SEQ ID NO: 256 (ENCODED BY SEQ ID NO: 255) | 0.49 | | | Y (4.2) |
| SEQ ID NO: 186 (ENCODED BY SEQ ID NO: 185) | 0.48 | | | Y (5) |
| SEQ ID NO: 124 (ENCODED BY SEQ ID NO: 123) | 0.48 | | | |
| SEQ ID NO: 162 (ENCODED BY SEQ ID NO: 161) | 0.48 | | | |
| SEQ ID NO: 270 (ENCODED BY SEQ ID NO: 269) | 0.46 | | | |
| SEQ ID NO: 276 (ENCODED BY SEQ ID NO: 275) | 0.45 | | | |
| SEQ ID NO: 190 (ENCODED BY SEQ ID NO: 189) | 0.45 | | | |
| SEQ ID NO: 274 (ENCODED BY SEQ ID NO: 273) | 0.45 | | | |
| SEQ ID NO: 214 (ENCODED BY SEQ ID NO: 213) | 0.44 | | | |
| SEQ ID NO: 290 (ENCODED BY SEQ ID NO: 289) | 0.44 | | | |
| SEQ ID NO: 306 (ENCODED BY SEQ ID NO: 305) | 0.42 | | | |
| SEQ ID NO: 118 (ENCODED BY SEQ ID NO: 117) | 0.42 | | | |
| SEQ ID NO: 30 (encoded by SEQ ID NO: 29) | 0.42 | | | |
| SEQ ID NO: 144 (ENCODED BY SEQ ID NO: 143) | 0.41 | | | |
| SEQ ID NO: 134 (ENCODED BY SEQ ID NO: 133) | 0.4 | | | |
| SEQ ID NO: 194 (ENCODED BY SEQ ID NO: 193) | 0.39 | | | |
| SEQ ID NO: 318 (ENCODED BY SEQ ID NO: 317) | 0.39 | | | |
| SEQ ID NO: 210 (ENCODED BY SEQ ID NO: 209) | | | | |
| SEQ ID NO: 240 (ENCODED BY SEQ ID NO: 239) | 0.38 | | Y | Y (2) |
| SEQ ID NO: 278 (ENCODED BY SEQ ID NO: 277) | 0.37 | | | |
| SEQ ID NO: 294 (ENCODED BY SEQ ID NO: 293) | 0.37 | | | |
| SEQ ID NO: 170 (ENCODED BY SEQ ID NO: 169) | 0.37 | | | |
| SEQ ID NO: 208 (encoded by SEQ ID NO: 207) | 0.37 | | | |
| SEQ ID NO: 128 (ENCODED BY SEQ ID NO: 127) | 0.36 | | | |
| SEQ ID NO: 132 (ENCODED BY SEQ ID NO: 131) | 0.36 | | | |
| SEQ ID NO: 158 (ENCODED BY SEQ ID NO: 157) | 0.36 | | | |
| SEQ ID NO: 178 (ENCODED BY SEQ ID NO: 177) | 0.36 | | | |
| SEQ ID NO: 166 (ENCODED BY SEQ ID NO: 165) | 0.34 | | | |
| SEQ ID NO: 196 (ENCODED BY SEQ ID NO: 195) | 0.34 | | Y | Y (8.2) |
| SEQ ID NO: 204 (ENCODED BY SEQ ID NO: 203) | 0.34 | | | |
| SEQ ID NO: 218 (ENCODED BY SEQ ID NO: 217) | 0.33 | | Y | |
| SEQ ID NO: 242 (ENCODED BY SEQ ID NO: 243) | 0.33 | | | |
| SEQ ID NO: 154 (ENCODED BY SEQ ID NO: 153) | 0.29 | | | Y (5.6) |
| SEQ ID NO: 300 (ENCODED BY SEQ ID NO: 299) | 0.28 | | | |
| SEQ ID NO: 338 (ENCODED BY SEQ ID NO: 337) | 0.27 | | | |
| SEQ ID NO: 284 (ENCODED BY SEQ ID NO: 283) | 0.27 | | | |
| SEQ ID NO: 112 (ENCODED BY SEQ ID NO: 111) | 0.27 | | | |
| SEQ ID NO: 224 (ENCODED BY SEQ ID NO: 223) | 0.27 | | | |
| SEQ ID NO: 136 (ENCODED BY SEQ ID NO: 135) | 0.26 | | | |
| SEQ ID NO: 430 (ENCODED BY SEQ ID NO: 429) | 0.26 | | | |
| SEQ ID NO: 198 (ENCODED BY SEQ ID NO: 197) | 0.25 | Y | Y | |
| SEQ ID NO: 428 (ENCODED BY SEQ ID NO: 427) | 0.25 | Y | | Y (2.6) |
| SEQ ID NO: 282 (ENCODED BY SEQ ID NO: 281) | 0.25 | | | |
| SEQ ID NO: 268 (ENCODED BY SEQ ID NO: 267) | 0.25 | | | |
| SEQ ID NO: 152 (ENCODED BY SEQ ID NO: 151) | 0.24 | Y | | Y (5.7) |
| SEQ ID NO: 38 (ENCODED BY SEQ ID NO: 37) | 0.23 | | | |
| SEQ ID NO: 292 (ENCODED BY SEQ ID NO: 291) | 0.23 | | | |
| SEQ ID NO: 232 (ENCODED BY SEQ ID NO: 231) | 0.23 | | | |

| Enzyme | [sugar] from AVICEL® MCC in 24 hr reaction, mM | Steam PCS | acid PCS | High severity alk-PCS (% conversion) |
|---|---|---|---|---|
| SEQ ID NO: 234 (ENCODED BY SEQ ID NO: 233) | 0.22 | | | |
| SEQ ID NO: 122 (ENCODED BY SEQ ID NO: 121) | 0.22 | | | |
| SEQ ID NO: 142 (ENCODED BY SEQ ID NO: 141) | 0.22 | | | |
| SEQ ID NO: 244 (ENCODED BY SEQ ID NO: 243) | 0.21 | | | |
| SEQ ID NO: 138 (ENCODED BY SEQ ID NO: 137) | 0.21 | | | |
| SEQ ID NO: 200 (ENCODED BY SEQ ID NO: 199) | 0.21 | | | |
| SEQ ID NO: 116 (ENCODED BY SEQ ID NO: 115) | 0.19 | | Y | Y (4.2) |
| SEQ ID NO: 114 (ENCODED BY SEQ ID NO: 113) | 0.19 | | | |
| SEQ ID NO: 248 (ENCODED BY SEQ ID NO: 247) | 0.19 | | | |
| SEQ ID NO: 360 (ENCODED BY SEQ ID NO: 359) | 0.18 | | | |
| SEQ ID NO: 184 (ENCODED BY SEQ ID NO: 183) | 0.18 | | | |
| SEQ ID NO: 192 (ENCODED BY SEQ ID NO: 191) | 0.18 | | | |
| SEQ ID NO: 222 (ENCODED BY SEQ ID NO: 221) | 0.17 | | | |
| SEQ ID NO: 140 (ENCODED BY SEQ ID NO: 139) | 0.16 | | | |
| SEQ ID NO: 168 (ENCODED BY SEQ ID NO: 167) | 0.14 | Y | | |
| SEQ ID NO: 182 (ENCODED BY SEQ ID NO: 181) | 0.13 | | | |
| SEQ ID NO: 220 (ENCODED BY SEQ ID NO: 219) | 0.13 | | | |
| SEQ ID NO: 260 (ENCODED BY SEQ ID NO: 259) | 0.13 | | | |
| SEQ ID NO: 262 (ENCODED BY SEQ ID NO: 261) | 0.12 | | Y | Y (0.4) |
| SEQ ID NO: 280 (ENCODED BY SEQ ID NO: 279) | 0.12 | | | |
| SEQ ID NO: 258 (ENCODED BY SEQ ID NO: 257) | 0.12 | | | |
| SEQ ID NO: 108 (ENCODED BY SEQ ID NO: 107) | 0.1 | | | |
| SEQ ID NO: 206 (ENCODED BY SEQ ID NO: 205) | 0.1 | | | |
| SEQ ID NO: 130 (ENCODED BY SEQ ID NO: 129) | 0.08 | | | |
| SEQ ID NO: 138 (ENCODED BY SEQ ID NO: 137) | 0.08 | | | |
| SEQ ID NO: 286 (ENCODED BY SEQ ID NO: 285) | 0.08 | | | |
| SEQ ID NO: 316 (ENCODED BY SEQ ID NO: 315) | 0.07 | | | Y (3) |
| SEQ ID NO: 296 (ENCODED BY SEQ ID NO: 295) | 0.07 | | | |
| SEQ ID NO: 288 (ENCODED BY SEQ ID NO: 287) | 0.07 | | | |
| SEQ ID NO: 202 (ENCODED BY SEQ ID NO: 201) | 0 | Y | Y | Y (4.9) |
| SEQ ID NO: 174 (ENCODED BY SEQ ID NO: 173) | 0 | | Y | |
| SEQ ID NO: 238 (ENCODED BY SEQ ID NO: 237) | 0 | | | Y (1.3) |
| SEQ ID NO: 416 (ENCODED BY SEQ ID NO: 415) | 0 | | | Y (1.7) |

Example 12

Optimizing Content of Enzyme Cocktails of the Invention

This example describes the discovery and development of enzymes, and mixes ("cocktails") of cellulolytic enzymes, for the hydrolysis of biomass, e.g., plant products, such as pretreated corn stover. This example describes the development and integration of a physical/chemical pretreatment of corn stover/fiber with an enzymatic hydrolysis (using a "cocktail" mix of enzymes of the invention) of complex polysaccharides to fermentable sugars. The invention provides enzymes and enzyme mixes for hydrolysis and saccharification of pretreated biomass. In one aspect, the invention provides enzymes and enzyme mixes using endoglucanases, cellobiohydrolases and/or β-glucosidases for biomass processing, e.g., saccharification of cellulose, for example, in pretreated stover. In one aspect, the enzyme cocktails of the invention are used to generate commercial cellulase and hemicellulase products, e.g., pretreated corn materials.

Cellobiohydrolase and β-Glucosidase Discovery

The invention provides enzymes that can take the products of an endoglucanase reaction on cellulosic substrates and convert them into monomer glucose. β-glucosidases were discovered, subcloned, expressed and characterized using assays designed to detect cellobiohydrolases and β-glucosidases. In summary, 89 active β-glucosidases and 28 active cellobiohydrolases were characterized.

Figure 80:
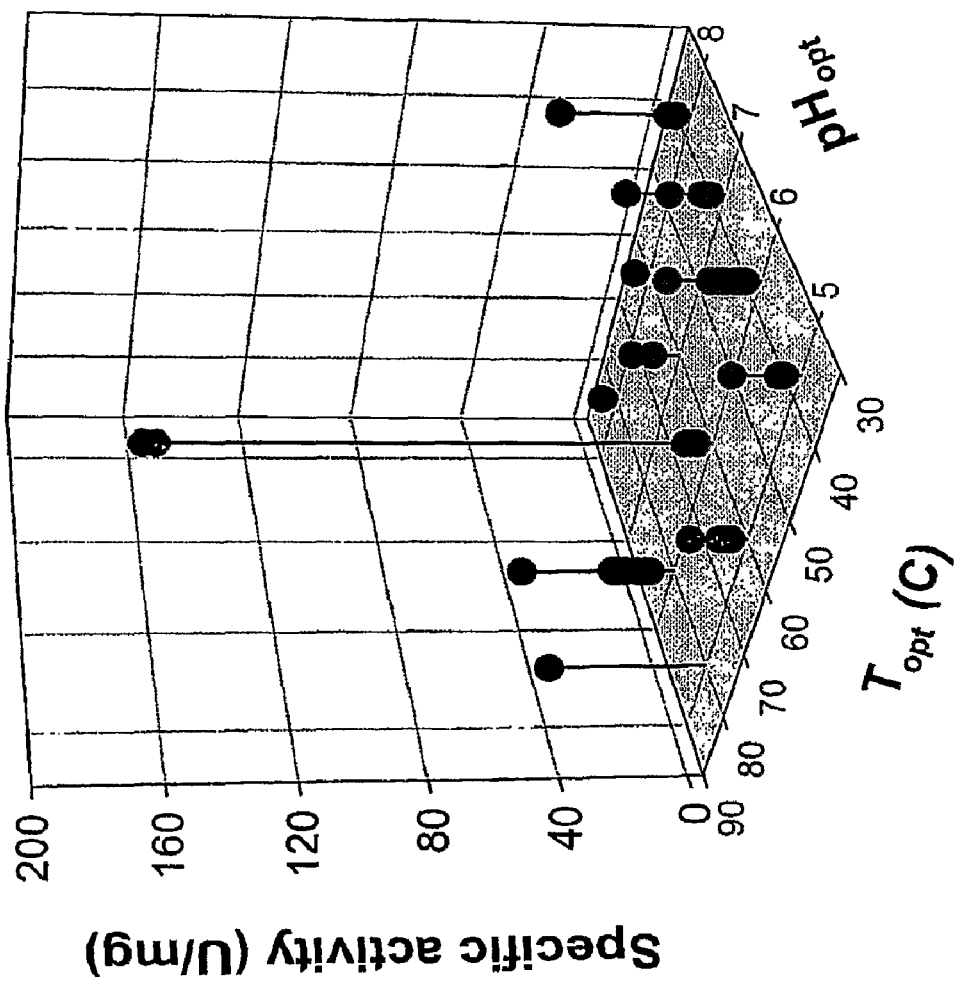
FIG. 80 graphically illustrates data showing pH and temperature optima of the screened β-glucosidases; as discussed in detail in Example 12, below.

Discovery was a combination of activity-based screens using model substrates (dye labeled sugars) and sequence-based discovery using probes designed from conserved sequences of known family 6 and 7 cellobiohydrolases. Discovery resulted in 16 new β-glucosidase genes while 77 genes. These genes were subcloned into appropriate expression vectors and characterized for activity on dye-labeled substrates, cellobiose and cellohexaose. Both pH and temperature optima were determined for each enzyme. In total 93 genes were analyzed for activity. Of the 93 subclones, 89 were shown to be active on the dye labeled substrate, pNP-β-glucopyranoside, as illustrated in FIG. 80 and the table (list), below, under a broad range of conditions; FIG. 80 graphically illustrates data showing pH and temperature optima of the screened β-glucosidases. This summarizes β-glucosidases of the invention with $pH_{opt}$, $T_{opt}$ and specific activity on the substrate pNP-β-glucopyranoside:

| Enzyme | $pH_{opt}$ | $T_{opt}$ | SA (U/mg) |
|---|---|---|---|
| SEQ ID NO: 254 (encoded by SEQ ID NO: 253) | 5 | 60 | 2.25 |
| SEQ ID NO: 264 (encoded by SEQ ID NO: 263) | 5 | 80 | 43.93 |
| SEQ ID NO: 340 (encoded by SEQ ID NO: 339) | 7 | 60 | 10.86 |
| SEQ ID NO: 364 (encoded by SEQ ID NO: 363) | 5 | 60 | 3.83 |
| SEQ ID NO: 356 (encoded by SEQ ID NO: 355) | 6 | 60 | 0.89 |

-continued

| Enzyme | pH$_{opt}$ | T$_{opt}$ | SA (U/mg) |
|---|---|---|---|
| SEQ ID NO: 326 (encoded by SEQ ID NO: 325) | 5 | 37 | 14.94 |
| SEQ ID NO: 358 (encoded by SEQ ID NO: 357) | 7 | 60 | 4.06 |
| SEQ ID NO: 320 (encoded by SEQ ID NO: 319) | 6 | 60 | 2.75 |
| SEQ ID NO: 346 (encoded by SEQ ID NO: 345) | 6 | 37 | 0.43 |
| SEQ ID NO: 348 (encoded by SEQ ID NO: 347) | 6 | 60 | 0.264 |
| SEQ ID NO: 362 (encoded by SEQ ID NO: 361) | 6 | 80 | 3 |
| SEQ ID NO: 342 (encoded by SEQ ID NO: 341) | 6 | 60 | 3.5 |
| SEQ ID NO: 336 (encoded by SEQ ID NO: 335) | 7 | 37 | 0.00728 |
| SEQ ID NO: 352 (encoded by SEQ ID NO: 351) | 6 | 80 | 13.5 |
| SEQ ID NO: 304 (encoded by SEQ ID NO: 303) | 5 | 60 | 0.5 |
| SEQ ID NO: 322 (encoded by SEQ ID NO: 321) | 6 | 37 | 8.02 |
| SEQ ID NO: 432 (encoded by SEQ ID NO: 431) | 6 | 60 | 0.7 |
| SEQ ID NO: 226 (encoded by SEQ ID NO: 225) | 6 | 37 | 0.185 |
| SEQ ID NO: 228 (encoded by SEQ ID NO: 227) | 5 | 60 | 0.31 |
| SEQ ID NO: 312 (encoded by SEQ ID NO: 311) | 7 | 37 | 0.38 |
| SEQ ID NO: 370 (encoded by SEQ ID NO: 369) | 5 | 37 | 0.21 |
| SEQ ID NO: 404 (encoded by SEQ ID NO: 403) | 5 | 37 | 0.229 |
| SEQ ID NO: 420 (encoded by SEQ ID NO: 419) | 6 | 37 | 2.883 |
| SEQ ID NO: 400 (encoded by SEQ ID NO: 399) | 6 | 37 | 2.369 |
| SEQ ID NO: 384 (encoded by SEQ ID NO: 383) | 7 | 37 | 0.88 |
| SEQ ID NO: 24 (encoded by SEQ ID NO: 23) | 8 | 37 | 2.743 |
| SEQ ID NO: 42 (encoded by SEQ ID NO: 41) | 5 | 37 | 1.57 |
| SEQ ID NO: 408 (encoded by SEQ ID NO: 407) | 6 | 37 | 23.083 |
| SEQ ID NO: 382 (encoded by SEQ ID NO: 381) | 6 | 60 | 1.82 |
| SEQ ID NO: 228 (encoded by SEQ ID NO: 227) | 6 | 37 | 6.77 |
| SEQ ID NO: 344 (encoded by SEQ ID NO: 343) | 5 | 37 | 0.0339 |
| SEQ ID NO: 332 (encoded by SEQ ID NO: 331) | 5 | 37 | 0.492 |
| SEQ ID NO: 150 (encoded by SEQ ID NO: 149) | 6 | 80 | 4.26 |
| SEQ ID NO: 230 (encoded by SEQ ID NO: 229) | 6 | 37 | 2.699 |
| SEQ ID NO: 310 (encoded by SEQ ID NO: 309) | 7 | 37 | 0.963 |
| SEQ ID NO: 94 (encoded by SEQ ID NO: 93) | 6 | 60 | 164.026 |
| SEQ ID NO: 6 (encoded by SEQ ID NO: 5) | 5 | 37 | 0.263 |
| SEQ ID NO: 298 (encoded by SEQ ID NO: 297) | 5 | 37 | 0.172 |
| SEQ ID NO: 376 (encoded by SEQ ID NO: 375) | 5 | 37 | 0.489 |
| SEQ ID NO: 148 (encoded by SEQ ID NO: 147) | 5 | 37 | 0.24 |
| SEQ ID NO: 386 (encoded by SEQ ID NO: 385) | 5 | 37 | 0.25 |
| SEQ ID NO: 350 (encoded by SEQ ID NO: 349) | 5 | 37 | 0.172 |
| SEQ ID NO: 18 (encoded by SEQ ID NO: 17) | 5 | 37 | 0.346 |
| SEQ ID NO: 50 (encoded by SEQ ID NO: 49) | 5 | 37 | 0.619 |
| SEQ ID NO: 424 (encoded by SEQ ID NO: 423) | 6 | 37 | 10.263 |
| SEQ ID NO: 422 (encoded by SEQ ID NO: 421) | 5 | 37 | 0.178 |
| SEQ ID NO: 8 (encoded by SEQ ID NO: 7) | 5 | 37 | 0.0879 |
| SEQ ID NO: 212 (encoded by SEQ ID NO: 211) | 8 | 80 | 0.228 |
| SEQ ID NO: 366 (encoded by SEQ ID NO: 365) | 8 | 37 | 0.052 |
| SEQ ID NO: 380 (encoded by SEQ ID NO: 379) | 5 | 37 | 0.336 |
| SEQ ID NO: 58 (encoded by SEQ ID NO: 57) | 5 | 37 | 0.0455 |
| SEQ ID NO: 58 (encoded by SEQ ID NO: 57) | 5 | 37 | 0.0181 |
| SEQ ID NO: 388 (encoded by SEQ ID NO: 387) | 6 | 60 | 168 |
| SEQ ID NO: 4 (encoded by SEQ ID NO: 3) | 6 | 37 | 0.506 |
| SEQ ID NO: 76 (encoded by SEQ ID NO: 75) | 5 | 60 | 0.73 |
| SEQ ID NO: 90 (encoded by SEQ ID NO: 89) | 5 | 60 | 12.6 |
| SEQ ID NO: 328 (encoded by SEQ ID NO: 327) | 6 | 60 | 0.16 |
| SEQ ID NO: 334 (encoded by SEQ ID NO: 333) | 5 | 60 | 3.09 |
| SEQ ID NO: 16 (encoded by SEQ ID NO: 15) | 6 | 60 | 1.08 |
| SEQ ID NO: 30 (encoded by SEQ ID NO: 29) | 8 | 37 | 36.6 |
| SEQ ID NO: 374 (encoded by SEQ ID NO: 373) | 5 | 37 | 0.027 |
| SEQ ID NO: 394 (encoded by SEQ ID NO: 393) | 6 | 60 | 1.91 |
| SEQ ID NO: 330 (encoded by SEQ ID NO: 329) | 7 | 37 | 12.3 |
| SEQ ID NO: 164 (encoded by SEQ ID NO: 163) | 8 | 60 | 0.35 |
| SEQ ID NO: 378 (encoded by SEQ ID NO: 377) | 5 | 37 | 0.033 |
| SEQ ID NO: 410 (encoded by SEQ ID NO: 409) | 5 | 37 | 0.29 |
| SEQ ID NO: 418 (encoded by SEQ ID NO: 417) | 5 | 37 | 0.02 |
| SEQ ID NO: 70 (encoded by SEQ ID NO: 69) | 6 | 37 | 0.77 |
| SEQ ID NO: 412 (encoded by SEQ ID NO: 411) | 5 | 37 | 0.12 |
| SEQ ID NO: 398 (encoded by SEQ ID NO: 397) | 6 | 60 | 2.26 |
| SEQ ID NO: 272 (encoded by SEQ ID NO: 271) | 6 | 37 | 1.49 |
| SEQ ID NO: 324 (encoded by SEQ ID NO: 323) | 7 | 37 | 2.31 |
| SEQ ID NO: 172 (encoded by SEQ ID NO: 171) | 5 | 60 | 1.97 |
| SEQ ID NO: 188 (encoded by SEQ ID NO: 187) | 6 | 80 | 7.06 |
| SEQ ID NO: 250 (encoded by SEQ ID NO: 249) | 6 | 80 | 15.35 |
| SEQ ID NO: 252 (encoded by SEQ ID NO: 251) | 6 | 80 | 11.21 |
| SEQ ID NO: 180 (encoded by SEQ ID NO: 179) | 5 | 37 | 0.03 |
| SEQ ID NO: 368 (encoded by SEQ ID NO: 367) | 5 | 37 | 0.1 |
| SEQ ID NO: 266 (encoded by SEQ ID NO: 265) | 7 | 37 | 0.04 |
| SEQ ID NO: 414 (encoded by SEQ ID NO: 413) | 5 | 37 | 0.071 |
| SEQ ID NO: 390 (encoded by SEQ ID NO: 389) | 5 | 37 | 0.01 |
| SEQ ID NO: 402 (encoded by SEQ ID NO: 401) | 6 | 37 | 10.6 |
| SEQ ID NO: 426 (encoded by SEQ ID NO: 425) | 7 | 37 | 25.7 |

-continued

| Enzyme | pH$_{opt}$ | T$_{opt}$ | SA (U/mg) |
|---|---|---|---|
| SEQ ID NO: 392 (encoded by SEQ ID NO: 391) | 6 | 80 | 44 |
| SEQ ID NO: 396 (encoded by SEQ ID NO: 395) | 6 | 37 | 5.7 |
| SEQ ID NO: 406 (encoded by SEQ ID NO: 405) | 5 | 37 | 0.17 |
| SEQ ID NO: 438 (encoded by SEQ ID NO: 437) | 5 | 37 | 0.2 |
| SEQ ID NO: 436 (encoded by SEQ ID NO: 435) | 6 | 37 | 0.004 |
| SEQ ID NO: 492 (encoded by SEQ ID NO: 491) | 6 | 37 | 2.5 |

Figure 81:
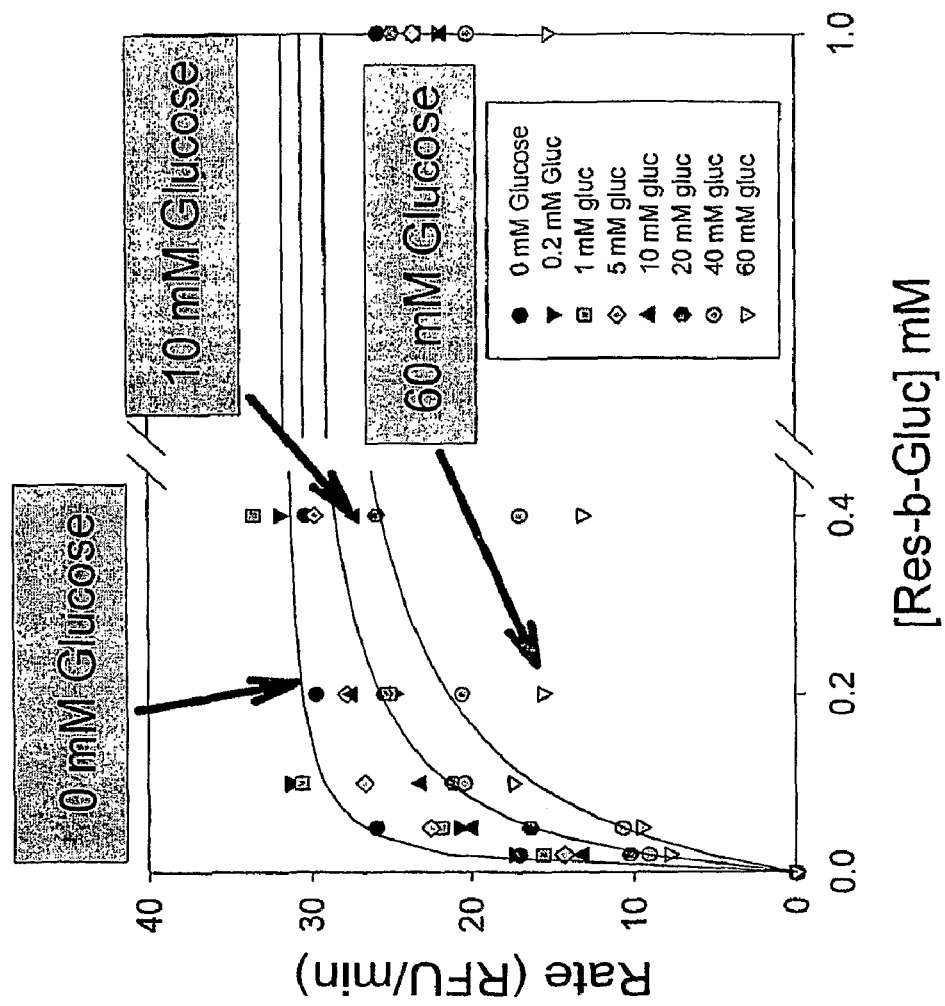
FIG. 81 graphically illustrates data showing glucose inhibition of an exemplary enzyme; as discussed in detail in Example 12, below.

The activity of the exemplary enzymes of the invention SEQ ID NO:264 (ENCODED BY SEQ ID NO:263), SEQ ID NO:94 (encoded by SEQ ID NO:93) and SEQ ID NO:388 (encoded by SEQ ID NO:387) was tested on cellobiose and cellohexaose. SEQ ID NO:94 (ENCODED BY SEQ ID NO:93) and SEQ ID NO:388 (encoded by SEQ ID NO:387) both were significantly more active on cellohexaose than on cellobiose while SEQ ID NO:264 (ENCODED BY SEQ ID NO:263) bad almost equivalent activity on these two substrates. The K$_m$ for cellobiose of SEQ ID NO:264 (ENCODED BY SEQ ID NO:263) was determined to be approximately 2.5 mM; consistent with literature values for other similar enzymes. Based on these results the exemplary SEQ ID NO:264 (ENCODED BY SEQ ID NO:263) was chosen as the top candidate to be used in the enzyme cocktails. During a biomass to ethanol process high concentrations of glucose are expected to accumulate and the potential for product inhibition exists. Experiments were designed to test for product inhibition of the exemplary SEQ ID NO:264 (ENCODED BY SEQ ID NO:263). FIG. 81 shows the results which indicated that indeed the exemplary SEQ ID NO:264 (ENCODED BY SEQ ID NO:263) is inhibited by high concentrations of glucose. FIG. 81 graphically illustrates data showing glucose inhibition of the exemplary enzyme SEQ ID NO:264 (ENCODED BY SEQ ID NO:263). Hydrolysis of Res-β-glucopyranoside was monitored in increasing concentrations of added glucose. Glucose concentrations ranged from 0 to 60 mM at the start of the reaction. Solid lines are fits to the Michaelis-Menten equation with increasing K$_m$ values.

Discovery of cellobiohydrolases of the invention was a combination of activity and sequence based approaches. The major focus was on fungal genes since the available literature suggests that, in general, fungal cellobiohydrolases are more active than their bacterial counterparts. 41 full-length fungal genes were discovered using sequence based discovery, and these genes were expressed and characterized. All 41 were cloned into *Pichia* and the filamentous fungus *Cochliobolus heterostrophus*; two were shown to be active in the *Pichia* constructs while 28 were active in the *Cochliobolus* constructs. Activity was measured on AVICEL® microcrystalline cellulose (MCC) and phosphoric acid swollen cellulose (PASC).

Figure 82:
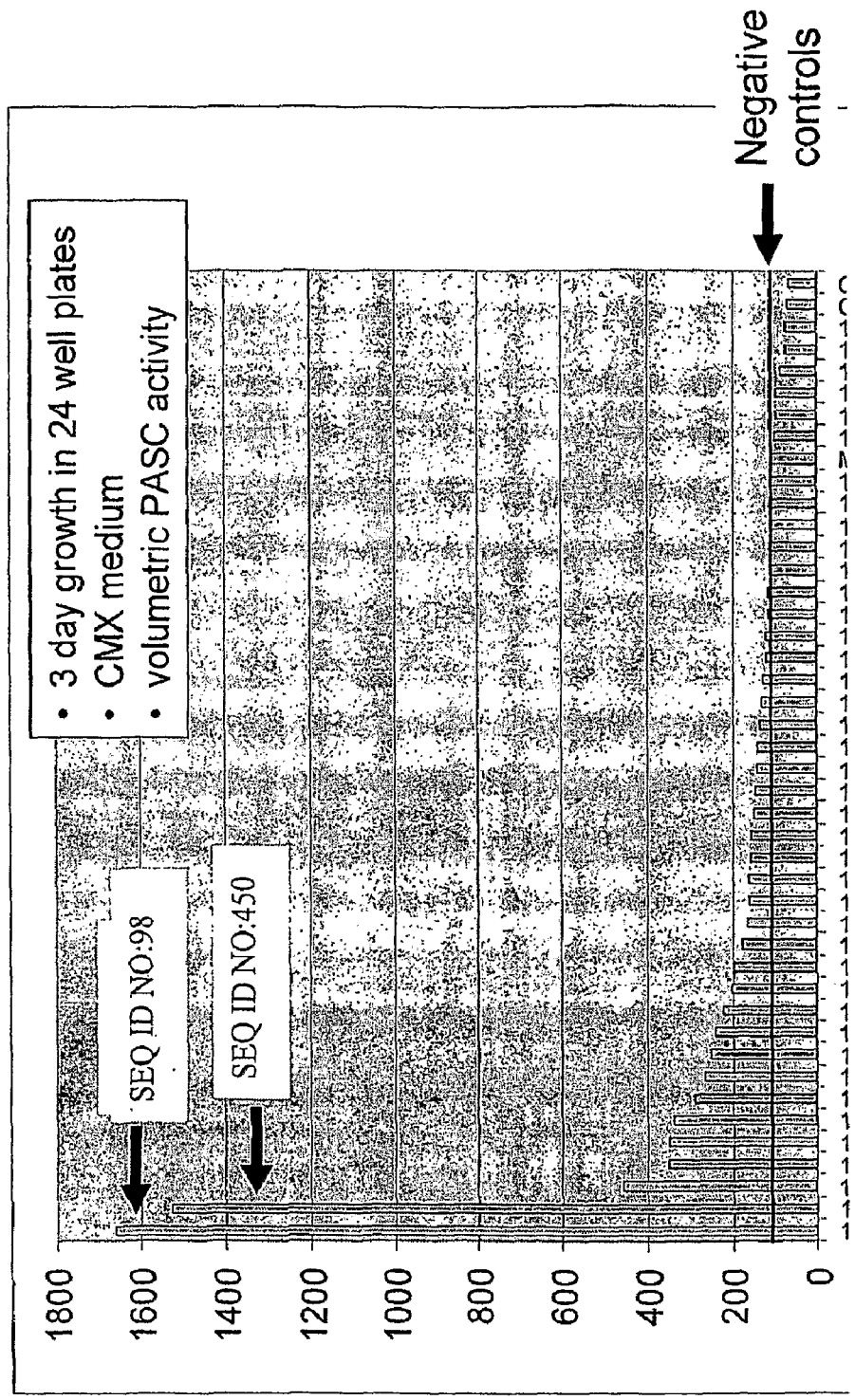
FIG. 82 graphically illustrates data showing digestion of phosphoric acid swollen cellulose (PASC) by recombinant *C. heterostrophus* strains comprising nucleic acids of the invention; as discussed in detail in Example 12, below.

FIG. 82 graphically illustrates data showing the range of PASC hydrolysis activity in all 41 strains of the invention, as compared to the wildtype controls (C5 and MelKO). Wild-type endogenous cellulase and hemicellulase activity is repressed when grown in a xylose or glucose medium (CMX contains xylose as the carbon source). In these assays the exemplary strains SEQ ID NO:98 (ENCODED BY SEQ ID NO:97) and SEQ ID NO:450 (ENCODED BY SEQ ID NO:449) (both family 6 CBH) had the highest activity after a 3 day growth in the 24 well plates. FIG. 82 graphically illustrates data showing digestion of phosphoric acid swollen cellulose (PASC) by recombinant *C. heterostrophus* strains comprising nucleic acids of the invention (encoding enzymes of the invention). C5 is the wild type strain, MKO is a strain with the melanin locus knocked-out and CMX is the growth medium. Secreted protein was incubated with PASC for 2 hrs at 50 C, pH 5. The amount of product produced was measured by the addition of b-glucosidase, glucose oxidase, horseradish peroxidase and Amplex Red.

Figure 83B:
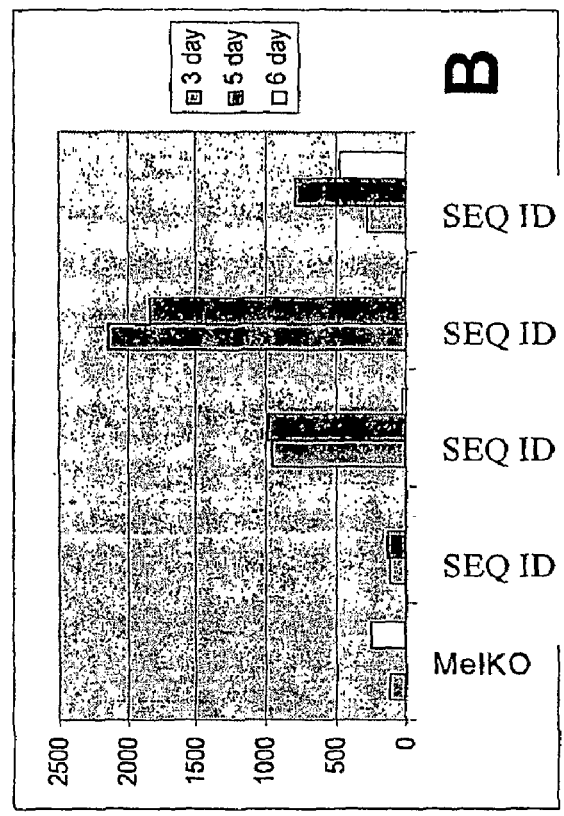
FIG. 83B—PASC activity of 4 different family 7 CBH containing strains during growth in 500 mL shake flasks, as discussed in detail in Example 12, below.
Figure 83A:
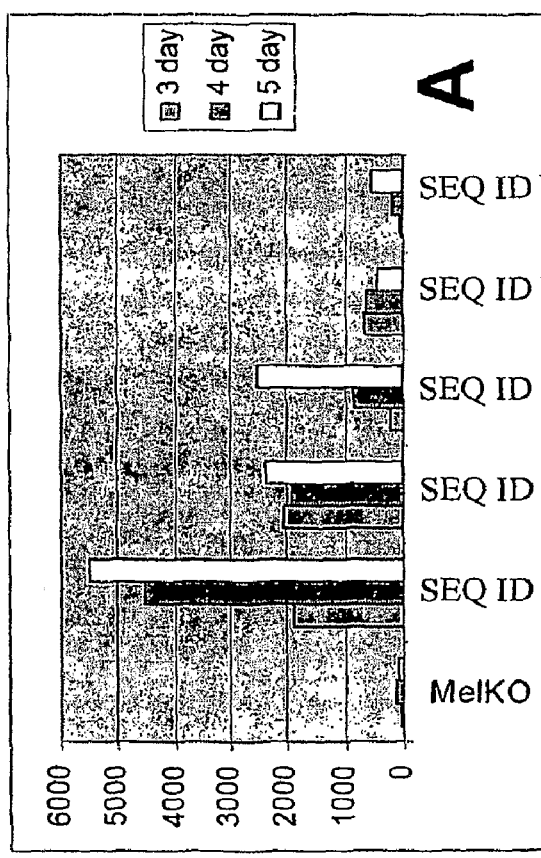
FIG. 83A—PASC activity of 5 different family 6 CBH containing strains during growth in 500 mL shake flasks.

Several family 7 and family 6 containing strains were selected and growth was scaled up to 500 mL shake flask. As seen in FIG. 83, activity is dependent upon number of days in the shake flask and tends to vary from strain to strain; in FIG. 83A, PASC activity of 5 different family 6 CBH containing strains during growth in 500 mL shake flasks; FIG. 83B, PASC activity of 4 different family 7 CBH containing strains during growth in 500 mL shake flasks.

The cellobiohydrolases were isolated from the exemplary enzymes of the invention SEQ ID NO:98 (ENCODED BY SEQ ID NO:97), SEQ ID NO:452 (ENCODED BY SEQ ID NO:451) and SEQ ID NO:34 (ENCODED BY SEQ ID NO:33) using either an affinity chromatography matrix (cellobiose based) or classical size exclusion chromatography. Proteomics analysis confirmed that the isolated protein was indeed the correct enzyme. Expression levels were estimated to be approximately mg active enzyme/L culture broth. These isolated proteins were used in the enzyme cocktails as described herein.

Digestion of PCS Using Enzyme Cocktails of the Invention

The invention provides enzyme cocktails to process biomass; for example, exemplary enzyme cocktails of the invention, when incubated with an appropriate pretreated biomass feedstock, have the following performance characteristics: in 48 hrs release 75% and 40% of theoretical glucose and xylose, respectively, using 5% solids and 20 mg/g cellulose.

Enzymes discovered (as discussed, above) were combined in such a way as to obtain the highest level of conversion of pretreated biomass. A number of pretreated biomass samples were used in the evaluation including low and high severity pretreated corn stover as well as pretreated cob samples ("Jaygo"). HPLC methods were utilized to monitor sugar release. Percent conversion was calculated based on compositional analysis of the pretreated material. In order to achieve these performance targets several different classes of enzymes were combined in appropriate ratios. These cocktails are referred to as "EX" where "X" is the number of enzymes combined. Performance was monitored by contacting the various enzyme cocktails with a pretreated biomass sample and measuring sugars released into the liquid phase. FIG. 84 shows the progression of percent conversion as different enzymes of the invention were combined; and the figure describes exemplary enzyme mixtures of the invention, e.g., E10, E9, etc.; the figure graphically illustrates the improvement in glucose and xylose conversion as enzymes of the invention are added to the cocktail.

Figure 85B:
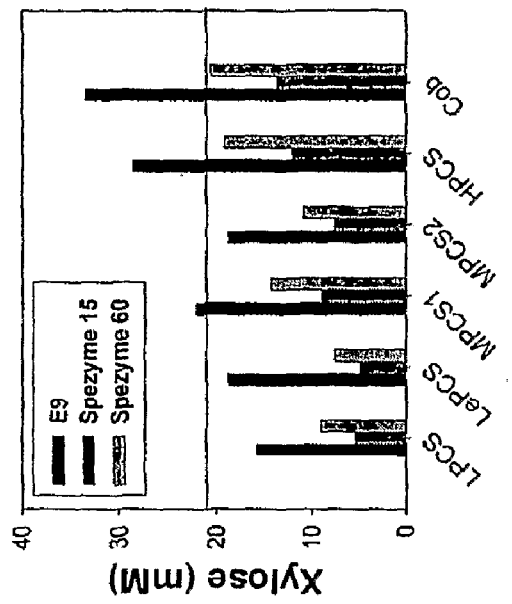
FIG. 85B, xylose released.
Figure 85A:
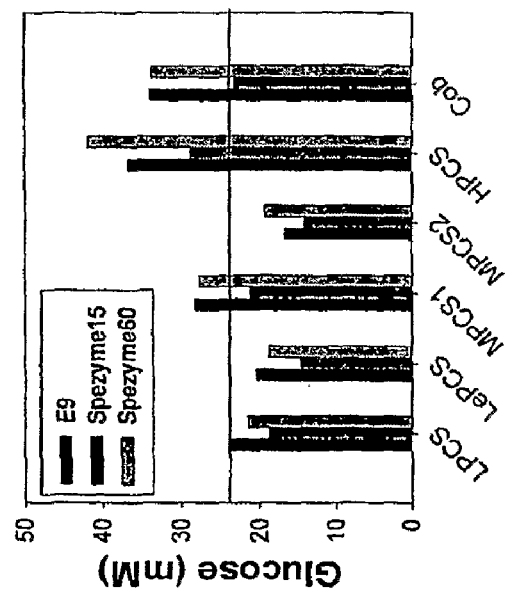
FIG. 85A, glucose released.
Figure 85C:
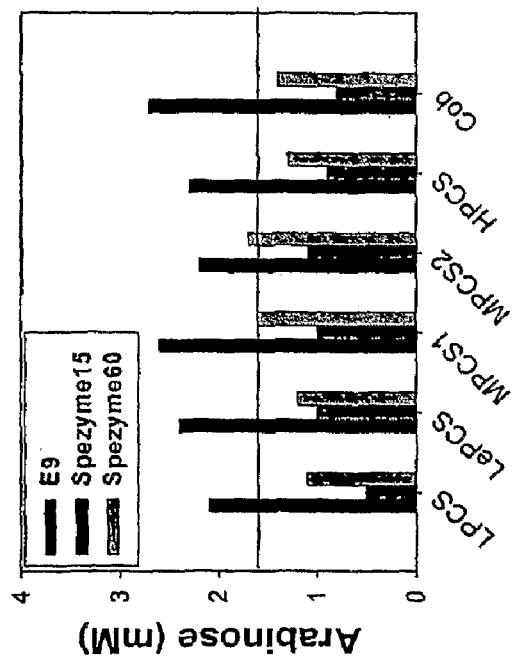
FIG. 85C, arabinose released; as discussed in detail in Example 12, below.

Cocktail performance (of enzyme mixes of the invention) was assessed on different pretreated materials (which vary in feedstock (stover vs. cob) and pretreatment characteristics, e.g., high, medium and low severity) and compared the cocktail performance to the performance of SPEZYME® cellulase at 2 different enzyme loadings (15 and 60 FPU/g cellulose). These data are shown in FIG. 85. In all cases the cocktails of the invention (enzyme mixes of the invention) outperformed the lower SPEZYME® cellulase loading and outperformed both low and high loadings of SPEZYME® cellulase for xylose and arabinose conversion. FIG. 85 graphically illustrates digestion of pretreated biomass feedstocks by SPEZYME® enzyme (15 and 60 FPU) and the exemplary enzyme mix of the invention designated "E9", by showing the amount of sugar released at 48 hrs (FIG. 85A, glucose released; FIG. 85B, xylose released; FIG. 85C, arabinose released). The horizontal line in each figure represents approximately 50% theoretical conversion. LPCS: low severity alkPCS; LePCS: extended time LPCS; MPCS1: medium severity condition 1 (140° F., 15% NH₃); MPCS2: medium severity condition 2 (170° C., 5% NH₃); HPCS, high severity alkPCS; cob, ammonia soaked cob, Jaygo 1.

Figure 86:
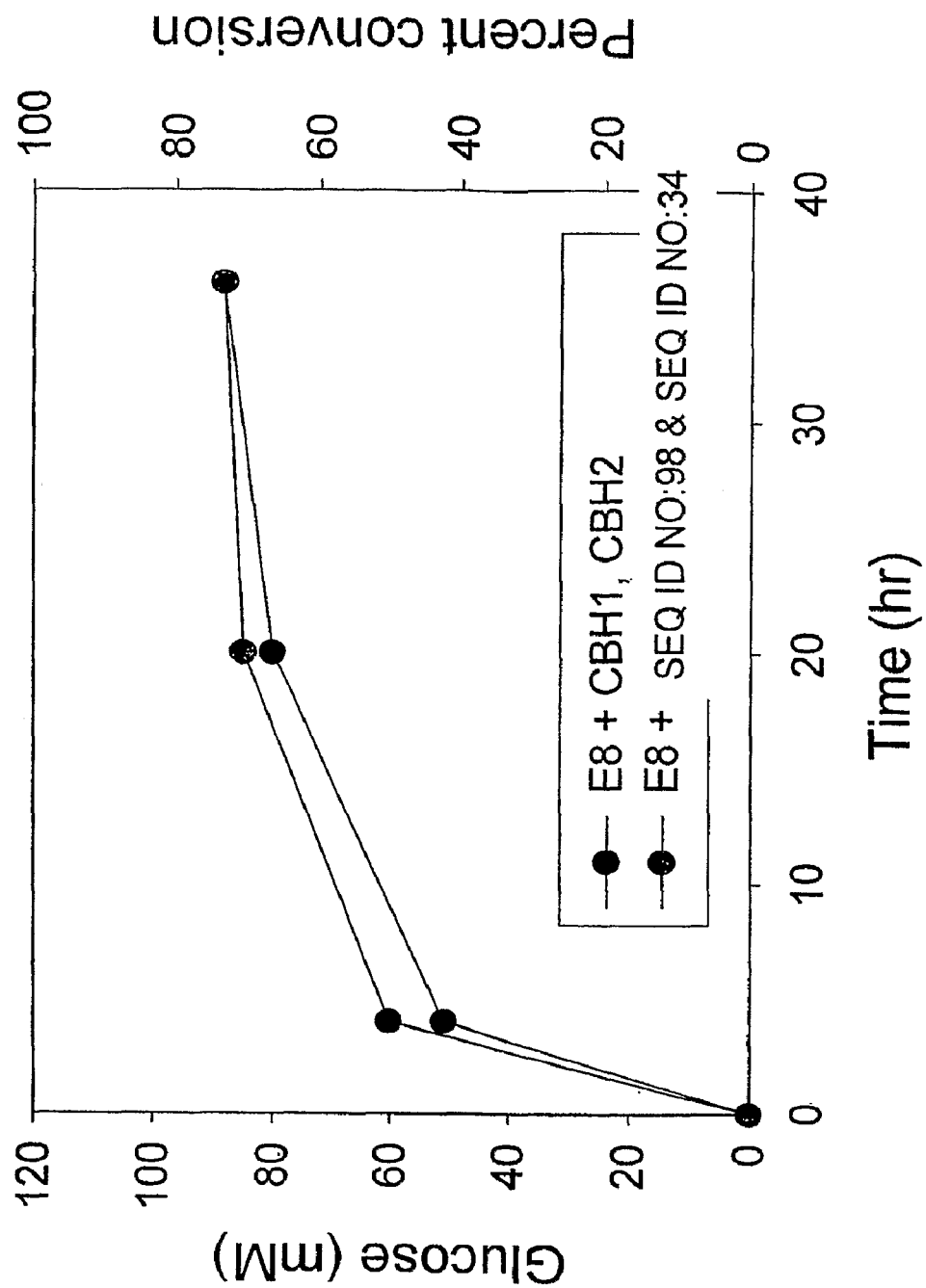
FIG. 86 graphically illustrates data showing glucose release from 5% solids pretreated corn cob (5 wt %) during incubation with the exemplary "E8" cocktail supplemented with either *T. reesei* CBH I and II or exemplary enzymes of the invention; as discussed in detail in Example 12, below.

The *Trichoderma* enzymes, CBH I and CBHII were used in the above exemplary cocktails of the invention; however, any cellobiohydrolases can be used. For example, FIG. 86 graphically illustrates data showing that the exemplary enzymes of the invention SEQ ID NO:34 (ENCODED BY SEQ ID NO:33) and SEQ ID NO:98 (ENCODED BY SEQ ID NO:97) can replace *T. reesei* CBH I and II in cocktails of the invention, e.g., the exemplary enzyme mix of the invention designated "E8". FIG. 86 graphically illustrates data showing glucose release from Jaygo 2 (5 wt %) during incubation with the exemplary "E8" cocktail supplemented with either *T. reesei* CBH I and II or SEQ ID NO:34 (ENCODED BY SEQ ID NO:33) and SEQ ID NO:98 (ENCODED BY SEQ ID NO:97).

Protein Purification and Quantitation

To quantify the amount of active enzyme used in the exemplary cocktails of the invention, it was necessary to purify each enzyme and determine specific activity of the pure (or enriched) protein. These data were then used to estimate the level of active protein in the protein samples used in the cocktails. For six of the enzymes crude cell free extracts were used in the cocktails, hence we back calculated the amount of enzyme in the crude mixtures based on the purified activity. However for the remaining two exemplary enzymes of the invention SEQ ID NO:98 (ENCODED BY SEQ ID NO:97) and SEQ ID NO:34 (ENCODED BY SEQ ID NO:33), the partially purified samples were actually used in the cocktails so estimates of active enzyme were based solely on SDS-PAGE analysis.

List of enzymes purified:
SEQ ID NO:264 (ENCODED BY SEQ ID NO:263): β-glucosidase
SEQ ID NO:106 (ENCODED BY SEQ ID NO:105): endoglucanase
SEQ ID NO:100 (ENCODED BY SEQ ID NO:99): family 11 xylanase
SEQ ID NO:102 (ENCODED BY SEQ ID NO:101): family 10 xylanase
SEQ ID NO:96 (ENCODED BY SEQ ID NO:95): β-xylosidase
SEQ ID NO:92 (ENCODED BY SEQ ID NO:91): α-arabinofuranosidase
SEQ ID NO:98 (ENCODED BY SEQ ID NO:97): family 6 cellobiohydrolase
SEQ ID NO:34 (ENCODED BY SEQ ID NO:33): family 7 cellobiohydrolase A summary of the purification results are:

| Enzyme | % active enzyme |
|---|---|
| SEQ ID NO: 264 (ENCODED BY SEQ ID NO: 263) | 5.6 |
| SEQ ID NO: 106 (ENCODED BY SEQ ID NO: 105) | 3 |
| SEQ ID NO: 100 (ENCODED BY SEQ ID NO: 99) | 15.5 |
| SEQ ID NO: 102 (ENCODED BY SEQ ID NO: 101) | 18.7 |
| SEQ ID NO: 96 (ENCODED BY SEQ ID NO: 95) | 2.7 |
| SEQ ID NO: 92 (ENCODED BY SEQ ID NO: 91) | 34 |
| SEQ ID NO: 98 (ENCODED BY SEQ ID NO: 97) | 46 |
| SEQ ID NO: 34 (ENCODED BY SEQ ID NO: 33) | 20 |
| Tr CBH I | 87 |
| Tr CBH II | 51 |

This table lists enzymes of the invention (by their "SEQ ID NO:" designations) used in biomass degrading cocktails and estimated percent of active enzyme in crude preparations.

Enzymatic Digestion of Pretreated Biomass

Enzymes, and enzyme cocktails, of the invention, are used to process biomass, as demonstrated by their effectiveness in processing pretreated biomass samples, e.g., the test sample "Jaygo 2". The composition of "Jaygo 2" is:

| | Percent composition | Ratio (liquid/solid) | Theoretical 100% conversion (5% solids) | | |
|---|---|---|---|---|---|
| | | | Total | (g/L) | (mM) |
| Glucan | 42.9 | 0.010 | 43.33 | 21.67 | 120.37 |
| Xylan | 31.22 | 0.084 | 33.85 | 16.93 | 112.84 |

Figure 87:
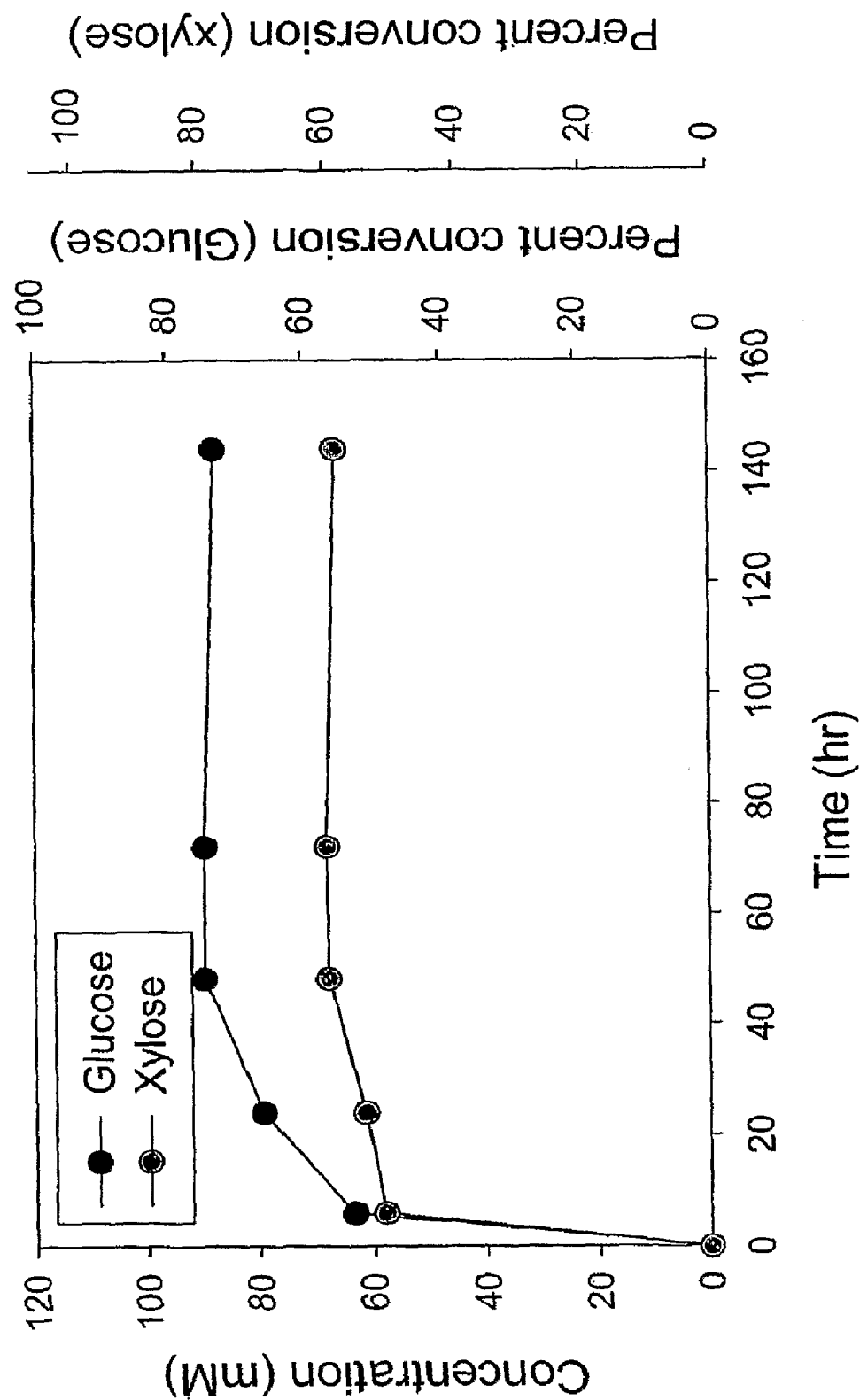
FIG. 87 and FIG. 88 graphically illustrate data showing digestion of Jaygo 2 (5% solids and 10% solids, respectively) using the cellulose SPEZYME® cellulase plus MULTIFECT® xylanase; as discussed in detail in Example 12, below.
Figure 88:
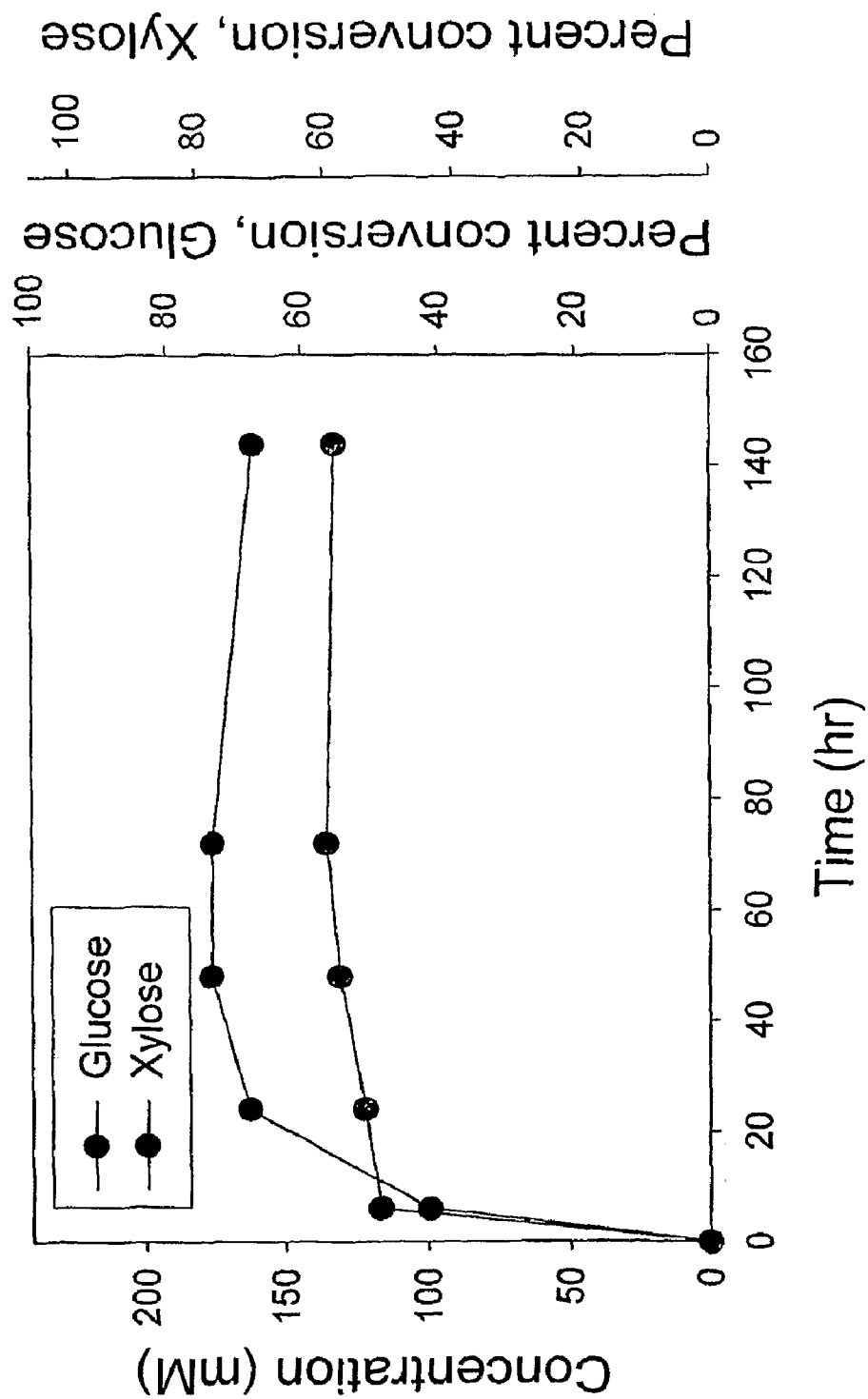

Each reaction was sampled at various time points and product concentration was determined by HPLC-RI. These values were used to calculate percent conversion during enzymatic hydrolysis; the composition of Jaygo 2 and theoretical concentration of glucose and xylose after 100% conversion of 5% solids reaction, In order to directly compare the performance of enzymes of the invention to a commercial benchmark, SPEZYME® cellulase performance was tested under the same conditions. The standard dosage of SPEZYME® cellulase of 15 FPU/g cellulose is equivalent to 58 mg protein/g cellulose. In the following experiments 7.5 FPU cellulase (29 mg) was combined with the protein equivalent of MULTIFECT® xylanase for a total of 58 mg/g cellulose. FIG. 87 shows the data obtained using 5% solids ("Jaygo 2", see above) in both absolute concentration and percent conversion. FIG. 88 shows the data set for 10% solids. FIG. 87 graphically illustrates data showing digestion of Jaygo 2 (5% solids) using 7.5 FPU/g cellulose SPEZYME® cellulase plus 7.5 "FPU equivalents"/g cellulose MULTIFECT® xylanase (in total 58 mg/g cellulose). Percent conversion was based on 120 mM glucose and 113 mM xylose as 100%. FIG. 88 graphically illustrates data showing digestion of Jaygo 2 (10% solids) using 7.5 FPU/g cellulose SPEZYME® cellulase plus 7.5 "FPU equivalents"/g cellulose MULTIFECT® xylanase (in total 58 mg/g cellulose). Percent conversion was based on 240 mM glucose and 226 mM xylose as 100%. Based on this data, performance is:

| Performance Parameters | SPEZYME ® enzyme | Benchmark Spezyme ® enzyme |
|---|---|---|
| mg active enzyme/g cellulose | 58 | 58 |

-continued

| Performance Parameters | SPEZYME ® enzyme | Benchmark Spezyme ® enzyme |
|---|---|---|
| Glucose: % Conversion | 75 | 73 |
| Glucose: Time for conversion (hr) | 48 | 48 |
| Xylose: % Conversion | 59 | 57 |
| Xylose: Time for conversion (hr) | 48 | 48 |
| % Solids | 5 | 10 |

The cocktail of 10 enzymes of the invention, designated "E10", has very high biomass saccharification activity. In this cocktail of the invention, four of the enzymes are responsible for digesting cellulose while the remainder are active on hemicellulose. As described above, a combination of protein purification, SDS-PAGE analysis and enzyme assays allowed a quantitative measure of the amount of active enzyme in each of the crude preparations. In order to reduce overall protein used in saccharification reactions a systematic approach was undertaken to remove redundant and unnecessary enzymes from the exemplary "E10" cocktail of the invention. It was determined that 2 of the enzymes, the exemplary SEQ ID NO:442 (ENCODED BY SEQ ID NO:441) (a α-glucuronidase) and the exemplary SEQ ID NO:440 (ENCODED BY SEQ ID NO:439) (a ferulic acid esterase) contributed very little to overall performance and were removed from the cocktail resulting in an E8 mixture. Experiments were carried out to determine which of the cellobiohydrolases (CBH I, CBH II, the exemplary SEQ ID NO:98 (ENCODED BY SEQ ID NO:97) and/or the exemplary SEQ ID NO:34 (ENCODED BY SEQ ID NO:33)) were the most effective. The performance from three different mixes was assessed; see discussion, above. In all three cases the total enzyme composition was tabulated and was below the 20 mg/g cellulose limit outlined in the target (case 1=18.4 mg/g; case 2=19.2 mg/g and case 3=17.2 mg/g).

Figure 89:
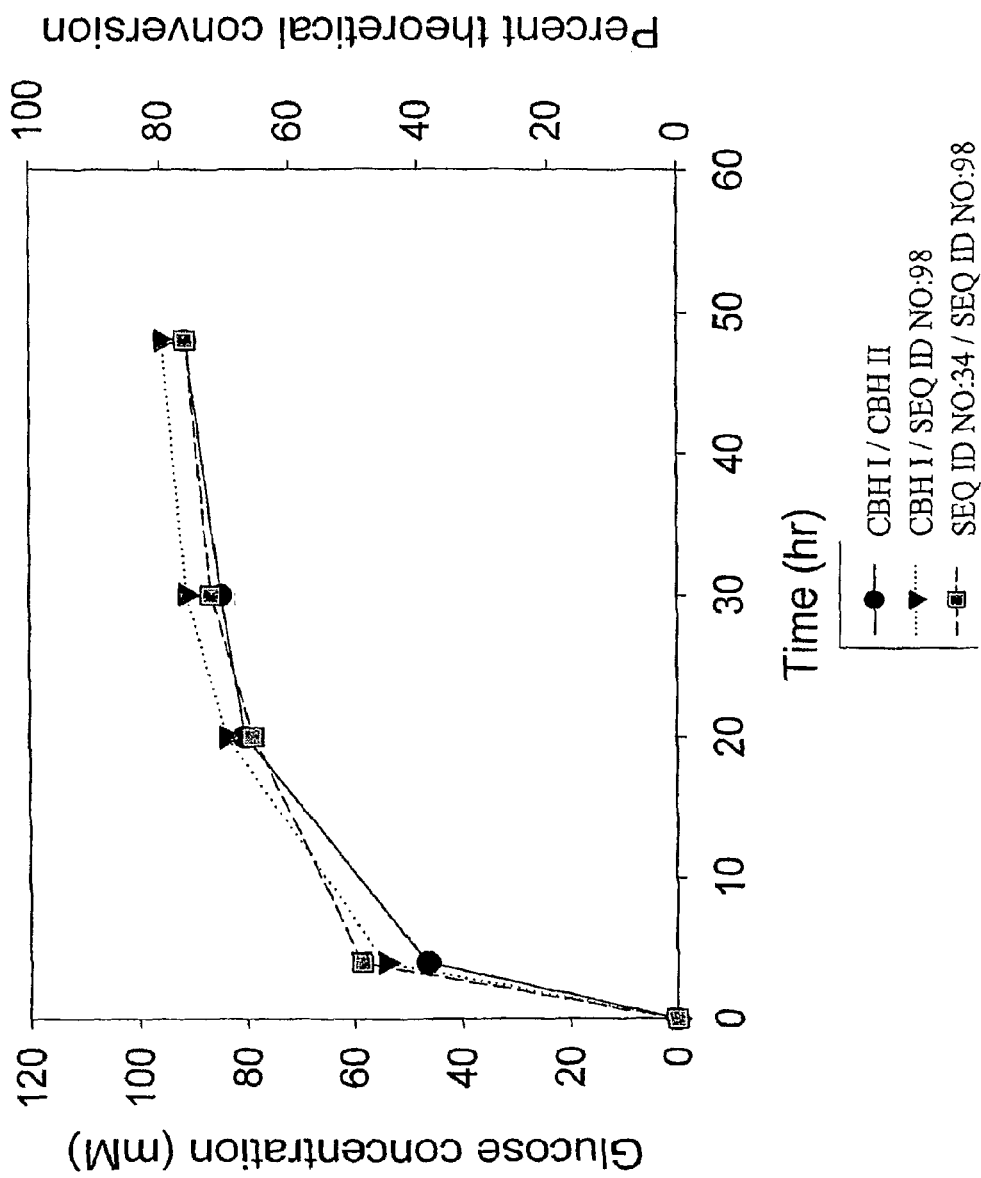
FIG. 89 and FIG. 90 graphically illustrate data showing glucose release from Jaygo 2 (5% solids) catalyzed by three different exemplary enzyme mixes of the invention; as discussed in detail in Example 12, below.
Figure 90:
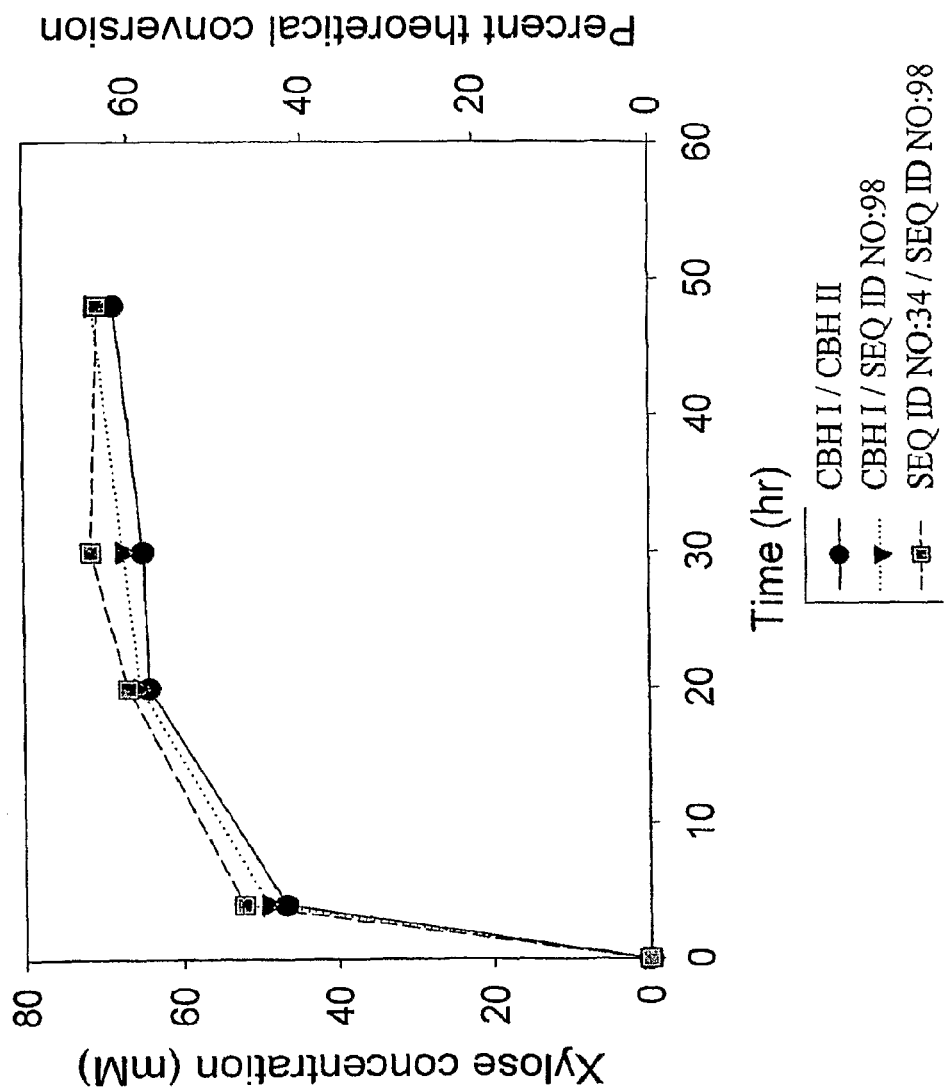

FIGS. 89 and 90 show the time courses of saccharification of "Jaygo 2" (see above) using the three enzyme mixes. While there were some minor differences in rates between the cases all three resulted in almost exactly 80% recovery of glucose and 62% recovery of xylose within 48 hrs. FIG. 89 graphically illustrates data showing glucose release from Jaygo 2 (5% solids) catalyzed by three different exemplary enzyme mixes of the invention, or "E8" cocktails: CBH I/CBH II is Case I; CBH I/SEQ ID NO:98 (ENCODED BY SEQ ID NO:97) is Case 2, and the exemplary enzymes of the invention SEQ ID NO:34 (ENCODED BY SEQ ID NO:33)/SEQ ID NO:98 (ENCODED BY SEQ ID NO:97) is Case 3. Glucose concentration was determined by HPLC analysis of the saccharified liquors sampled at 4, 20, 30 and 48 hrs. Percent conversion was calculated by using 120 mM as 100% available glucose in the pretreated solids. Reaction conditions are pH 5.5 and 50° C. FIG. 90 graphically illustrates data showing xylose release from Jaygo 2 (5% solids) catalyzed by three different exemplary enzyme mixes of the invention, or "E8" cocktails: CBH I/CBH II; CBH I/SEQ ID NO:98 (ENCODED BY SEQ ID NO:97), and the exemplary enzymes of the invention SEQ ID NO:34 (ENCODED BY SEQ ID NO:33)/SEQ ID NO:98 (ENCODED BY SEQ ID NO:97). Xylose concentration was determined by HPLC analysis of the saccharified liquors sampled at 4, 20, 30 and 48 hrs. Percent conversion was calculated by using 113 mM as 100% available xylose in the pretreated solids. Reaction conditions are pH 5.5 and 50° C. The performance of the exemplary enzyme mixes of the invention, or "E8" cocktails, compared to SPEZYME® cellulase is tabulated below:

| Performance Parameters | Benchmark SPEZYME ® cellulase | Case 1 | Case 2 | Case 3 |
|---|---|---|---|---|
| mg active enzyme/g cellulose | 58 | 18.4 | 19.2 | 17.2 |
| Glucose: % Conversion | 75 | 76 | 79 | 76 |
| Glucose: Time for conversion (hr) | 48 | 48 | 48 | 48 |
| Xylose: % Conversion | 59 | 57 | 58 | 59 |
| Xylose: Time for conversion (hr) | 48 | <20 | <20 | <20 |
| % Solids | 5 | 5 | 5 | 5 |

In summary, E8 outperformed SPEZYME® cellulase/MULTIFECT® xylanase (rate and extent) with approximately one-third the amount of protein/g cellulose.

Enzymes of the Invention for Higher Solids Saccharification

Figure 91:
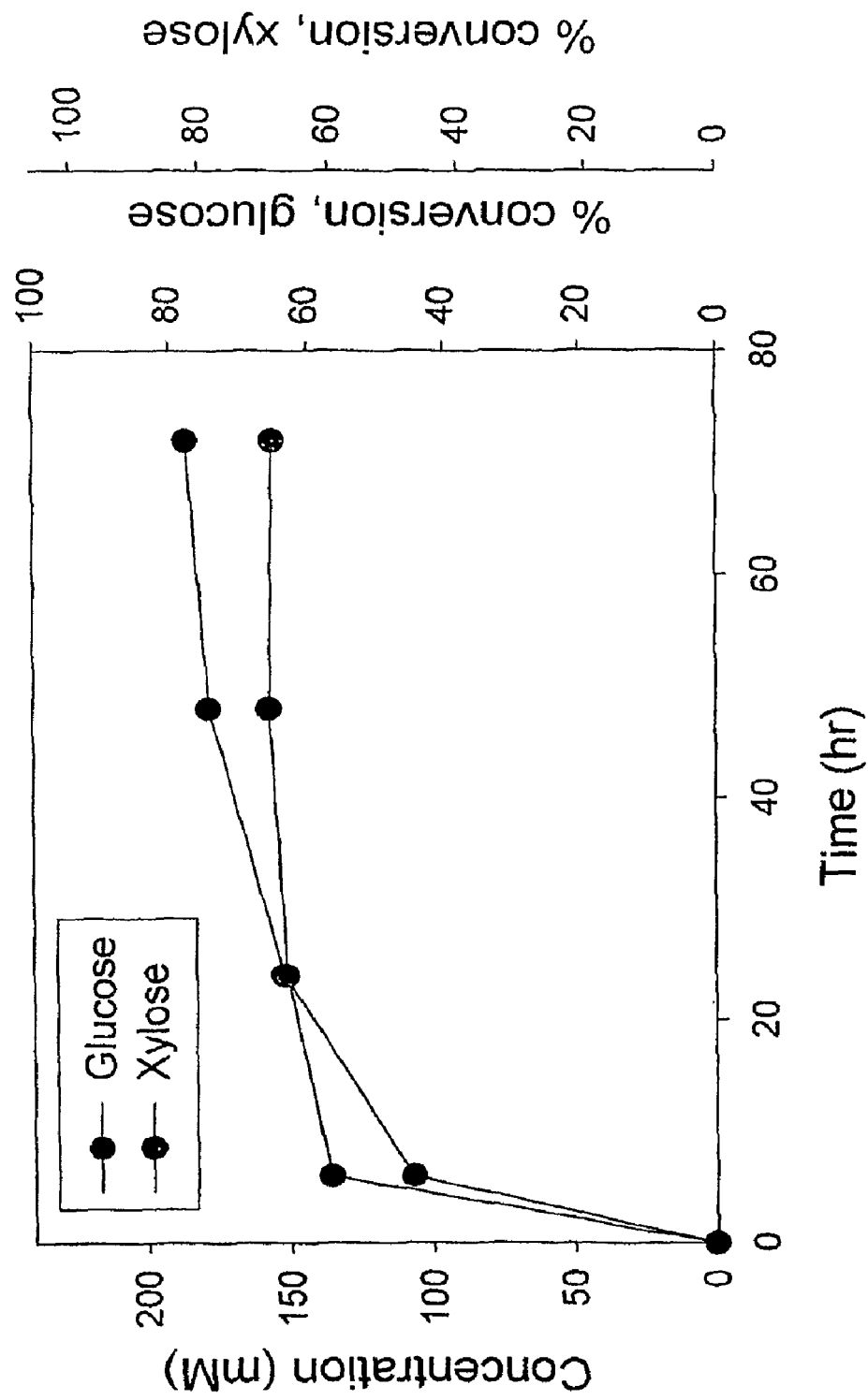
FIG. 91 graphically illustrates data showing the digestion of Jaygo 2 (10% solids) using the exemplary "E9" enzyme mix of the invention on cellulose; as discussed in detail in Example 12, below.

The invention also provides compositions (enzyme cocktails) for processing biomass solids loadings higher than 5%, but with low enzyme content, and methods for processing biomass solids loadings higher than 5%, but with low enzyme content. The performance of enzyme cocktails of the invention at 10% solids was evaluated, where the amount of protein in the cocktails was reduced from 20 mg/g cellulose to approximately 12 mg/g cellulose. Initial experiments were performed at enzyme loadings similar to the standard SPEZYME® cellulase/MULTIFECT® xylanase mixtures (58 mg protein/g cellulose). Under these reaction conditions the exemplary "E9" enzyme cocktail of the invention reached 74% and 70% conversion for glucose and xylose, respectively. FIG. 91 graphically illustrates data showing the digestion of Jaygo 2 (10% solids) using 58 mg "E9"/g cellulose; percent conversion was based on 240 mM glucose and 226 mM xylose as 100%. These data are shown in FIG. 91 and summarized in this table, showing the performance characteristics of an exemplary "E9" enzyme cocktail of the invention at 58 mg/g cellulose loading and 10% solids:

| Performance Parameters | E9 cocktail |
|---|---|
| mg active enzyme/g cellulose | 58 |
| Glucose: % Conversion | 74 |
| Glucose: Time for conversion (hr) | 48 |
| Xylose: % Conversion | 71 |
| Xylose: Time for conversion (hr) | 48 |
| % Solids | 10 |

Figure 92:
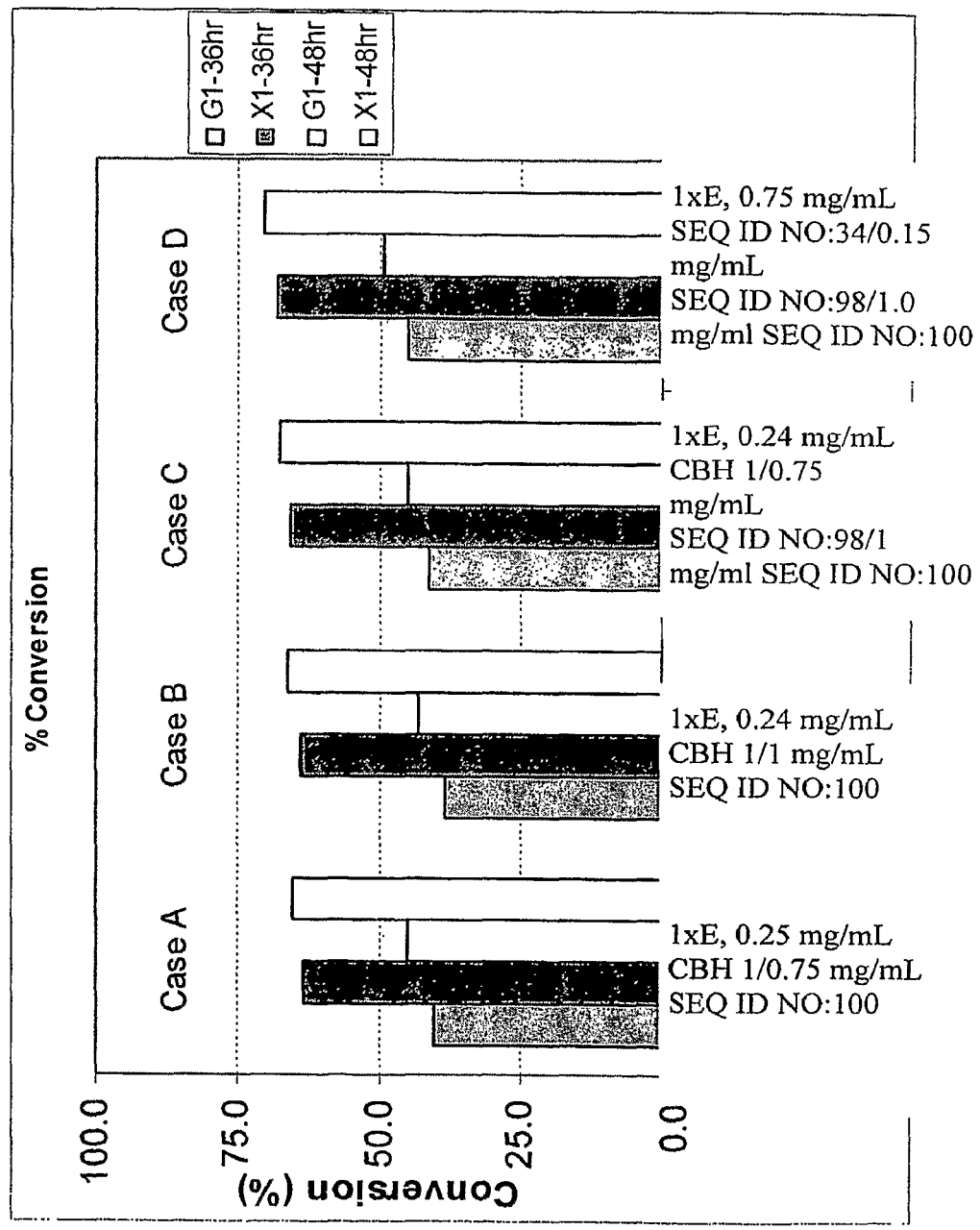
FIG. 92 graphically illustrates the level of conversion of glucose (G1) and xylose (X1) using 10% solids Jaygo 2 and a number of enzyme recipes that vary in cellulase and hemicellulase content; as discussed in detail in Example 12, below.

The next goal was to decrease protein dosage to approximately 12 mg/g cellulose. Four different recipes for the exemplary "E9" enzyme cocktail of the invention were used, altering the hemicellulase and cellulase ratios. FIG. 92 shows the amount of xylose and glucose released at 36 and 48 hrs for each situation. FIG. 92 graphically illustrates the level of conversion of glucose (G1) and xylose (X1) using 10% solids Jaygo 2 and a number of enzyme recipes that vary in cellulase and hemicellulase content. Cellulose hydrolysis was sensitive to both the cellulase and hemicellulase concentrations (a synergy between the enzyme types) whereas hemicellulose hydrolysis (as measured by xylose release) was sensitive only to hemicellulase content. Under these conditions xylose conversion is maintained at about 60% at 36 hrs while glucose conversion drops to approximately 50% as compared to performance at a higher enzyme loading.

Figure 93B:
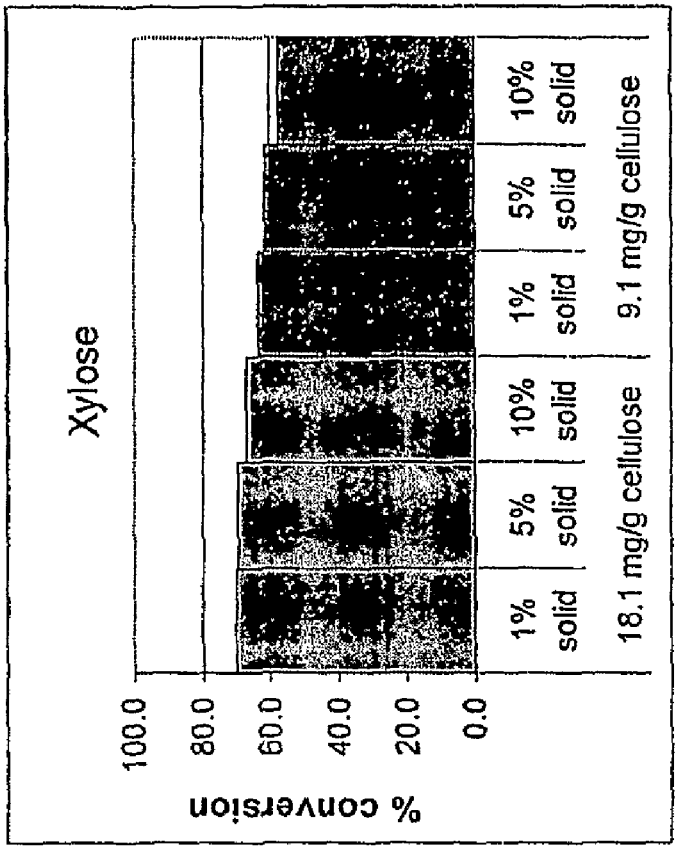
FIG. 93B graphically illustrates percent xylose conversion at 48 hrs using exemplary enzyme mixes of the invention and solids (Jaygo 2) loadings; as discussed in detail in Example 12, below.
Figure 93A:
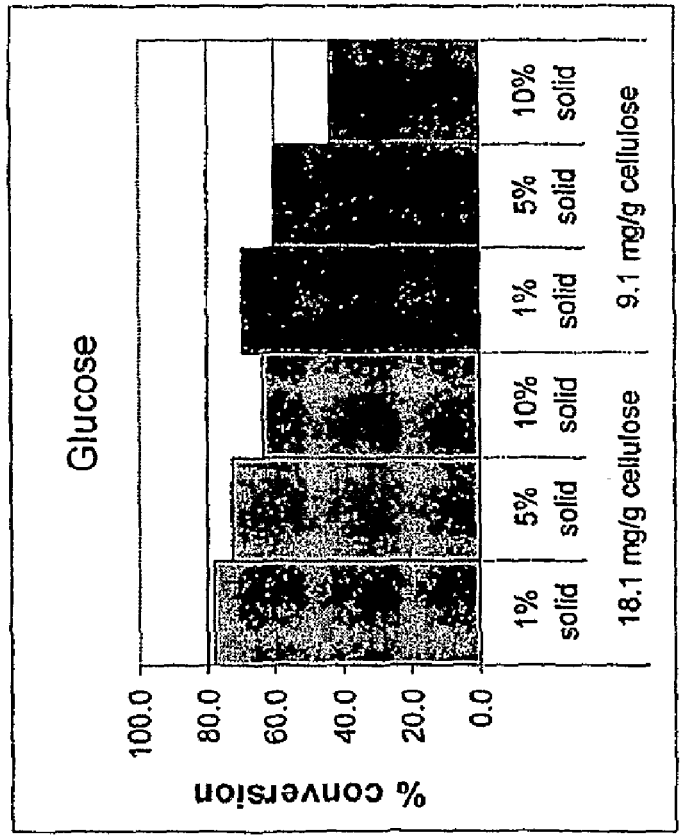
FIG. 93A graphically illustrates percent glucose conversion using exemplary enzyme mixes of the invention and solids (Jaygo 2) loadings.

A systematic study was undertaken in order to clarify the interplay between biomass solids content and enzyme loading. Reactions were set up with 18 mg protein/g cellulose and 9 mg protein/g cellulose at 1%, 5% and 10% Jaygo 2. FIGS. 93A and 93B summarize the data and show that glucose release was much more sensitive to solids loading than xylose, as a matter of fact at the high enzyme load (18 mg/g) there was almost no difference in xylose yield between the different percent solids in the reactor. Possible explanations for the decrease in performance as substrate concentration increases are (1) product inhibition by glucose, xylose, cellobiose or xylobiose (2) mass transfer (mixing) deficiencies or (3) a combination of both. FIG. 93A graphically illustrates percent glucose conversion at 48 hrs using different enzyme mixes of the invention (the "E8" cocktail) and solids (Jaygo 2) loadings; FIG. 93B graphically illustrates percent xylose conversion at 48 hrs using different enzyme mixes of the invention (the "E8" cocktail) and solids (Jaygo 2) loadings.

A summary of the performance of these exemplary enzyme cocktails of the invention, as compared to the performance target and measured benchmarks, is summarized:

by SEQ ID NO:443) and SEQ ID NO:100 (encoded, e.g., by SEQ ID NO:99) enzymes, were demonstrated to be able to perform this function. Both of these enzymes are so-called family 11 endoxylanases.

Additional screening comprised screening about 250 xylanase enzymes alone or in combination with the exemplary SEQ ID NO:100 (encoded, e.g., by SEQ ID NO:99) and/or SEQ ID NO:444 (encoded, e.g., by SEQ ID NO:443) enzymes for their ability to release reducing sugars from a pretreated biomass sample (low and high severity alkaline PCS). We found that the exemplary SEQ ID NO:100 (encoded, e.g., by SEQ ID NO:99) was a better performer than the exemplary SEQ ID NO:444 (encoded, e.g., by SEQ ID NO:443) (i.e. released slightly more reducing sugars at pH 5 and 50° C.) and that the addition of a family 10 endoxylanase increased the xylose yield.

Several candidates were found and the exemplary SEQ ID NO:102 (encoded, e.g., by SEQ ID NO:101) enzyme of the invention performed the best. β-xylosidases are responsible for the conversion of xylooligomers into xylose monomer; eight β-xylosidases were screened for effectiveness on xylobiose at pH 5 and 50 C and one candidate was chosen, the exemplary SEQ ID NO:96 (encoded, e.g., by SEQ ID NO:95). Arabinofuranosidases (the exemplary SEQ ID

| Performance parameters | Benchmark | Measured Benchmark* | Exemplary E8 cocktail** | Exemplary E8 cocktail | Exemplary E9 cocktail |
|---|---|---|---|---|---|
| mg active enzyme/g cellulose | 20 | 58 (15 FPU) | 19.2 | 12 | 58 |
| Glucose: % conversion | 80 | 73 | 79 | 50 | 74 |
| Glucose: Conversion time (h) | 48 | 48 | 48 | 36 | 48 |
| Xylose: % conversion | 65 | 57 | 58 | 62 | 70 |
| Xylose: Conversion time (h) | 48 | 48 | <20 | 36 | 48 |
| % solids | 2.5 | 10 | 5 | 10 | 10 |

*7.5 FPU Spezyme cellulase plus 7.5 "FPU equivalents" MULTIFECT xylanase
**Case 2

Hemicellulase Characterization

The invention provides enzymes, and enzyme mixes, or "cocktails", that are effective in processing, or hydrolyzing, plant hemicelluloses—which are complex, branched molecules consisting of a main chain of β1,4-linked xylan decorated with of a variety of other sugars, such as arabinose, galactose and mannose, or on occasion xylan may also be decorated with glucuronic acid, acetylated to a certain extent and linked to lignin via ferulic acid ester or ether linkages; and in alternative aspects completely or partially degrade the hemicellulose to monomer, or to intermediate oligomers and monomers. The enzyme mixes, or "cocktails", of the invention are particularly effective because hemicellulose is a much more complex material than cellulose and requires mixes of enzymes to completely degrade to monomer.

Figures 94A, 94B:
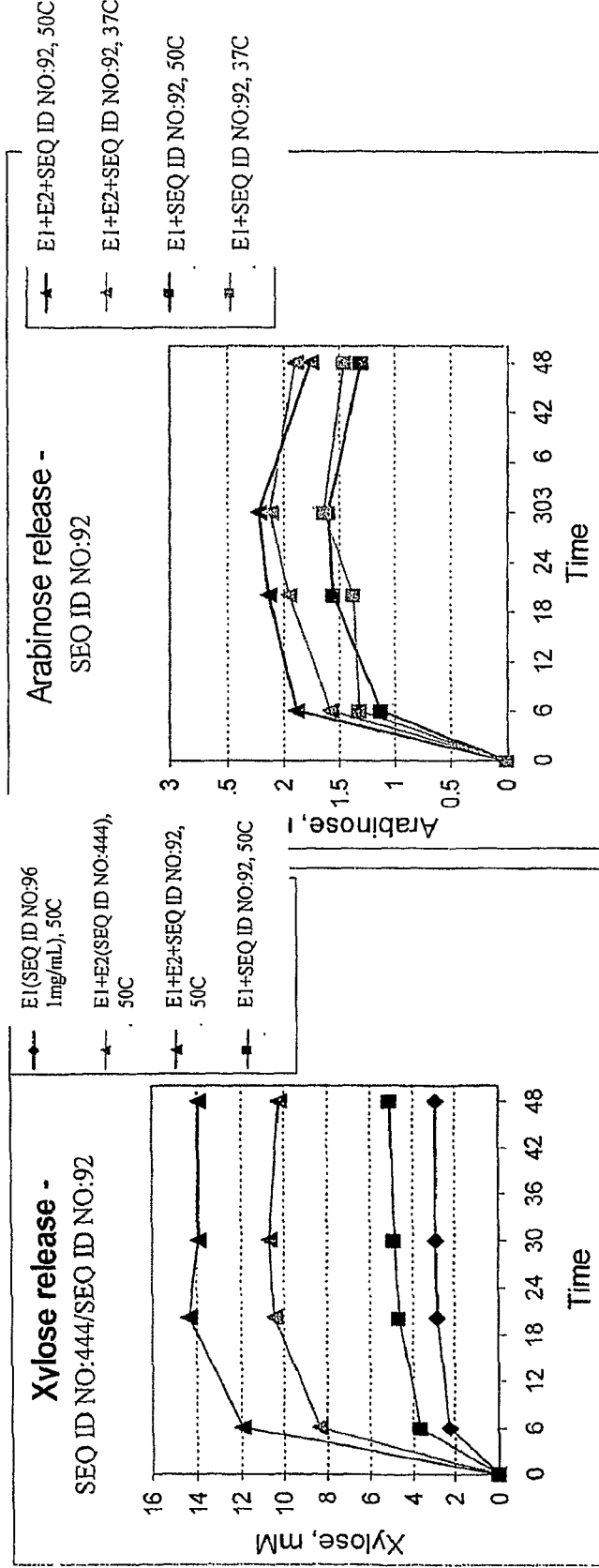
FIG. 94 graphically illustrates xylose release (FIG. 94A) and arabinose release (FIG. 94B) from low severity alkPCS (2.2% solids) by exemplary xylosidase, xylanase and arabinofuranosidase of the invention; as discussed in detail in Example 12, below.

The invention provides effective endo-xylanases that can quickly partially degrade a hemicellulose, e.g., a hemicellulose in pretreated biomass, into smaller oligosaccharides. The endo-xylanase(s) of the invention, or any endo-xylanase(s) used in the enzyme mixes, or "cocktails", of the invention, can solubilize biomasses, e.g., hemicellulose-comprising solids, and produce oligosaccharides on which the other hemicellulases will act. Two exemplary enzymes of the invention are xylanases, the exemplary SEQ ID NO:444 (encoded, e.g., NO:92 (encoded, e.g., by SEQ TD NO:91), SEQ ID NO:454 (encoded, e.g., by SEQ ID NO:453) and SEQ ID NO:456 (encoded, e.g., by SEQ ID NO:455) enzymes of the invention) were also screened for enhancement of xylose release and release of arabinose. As can be seen in FIGS. 94A and 94B, the addition of arabinofuranosidase not only increased the yield of arabinose from PCS but also allowed more xylose to be released. FIG. 94 graphically illustrates xylose release (FIG. 94A) and arabinose release (FIG. 94B) from low severity alkPCS (2.2% solids) by xylosidase (the exemplary SEQ ID NO:96 (encoded, e.g., by SEQ ID NO:95)); xylanase (the exemplary SEQ ID NO:444 (encoded, e.g., by SEQ ID NO:443)) and arabinofuranosidase (the exemplary SEQ ID NO:92 (encoded, e.g., by SEQ ID NO:91)) (pH 5, 50° C.).

It was also found that the addition of a ferulic acid esterase, the exemplary SEQ ID NO:440 (encoded, e.g., by SEQ ID NO:439), and α-glucuronidase, the exemplary SEQ ID NO:442 (encoded, e.g., by SEQ ID NO:441), resulted in slightly higher xylose-release from PCS. Therefore, SEQ ID NO:440 (encoded, e.g., by SEQ ID NO:439) and SEQ ID NO:442 (encoded, e.g., by SEQ ID NO:441) enzymes were included in these exemplary enzyme cocktails of the invention.

Analytical Characterization of Unhydrolyzed Oligomeric Xylan.

In one aspect, the processes of the invention comprise initial digestion of insoluble polysaccharides, e.g., in biomasses, such as pretreated corn samples, to soluble oligosaccharides; and, in one aspect, to their ultimate conversion to monomeric sugars. A SPEZYME cellulase/MULTIFECT xylanase mixture can produce complex soluble oligosaccharides from pretreated corn cob samples. Acid hydrolysis of the saccharification liquors resulted substantial increase in glucose and xylose monomer, indicating that the enzyme mixture is deficient in exoglycosidase activity. The exemplary enzyme mix of the invention, the so-called "E10 cocktail", on the other hand, produced a much simpler mix of soluble oligosaccharides.

Figure 95B:
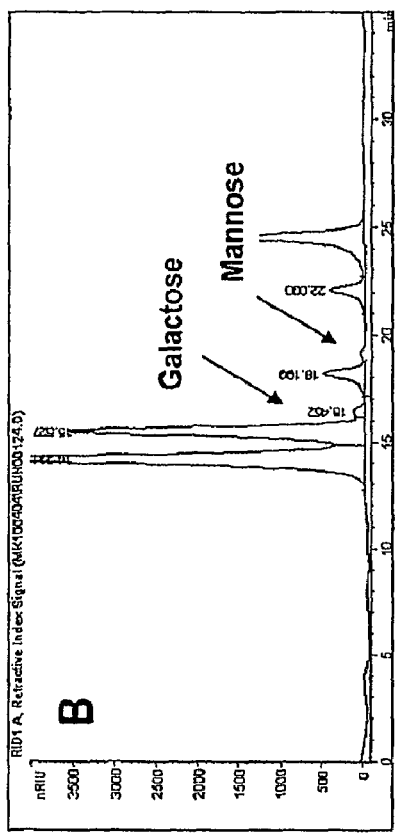
FIG. 95 illustrates chromatograms of the results of using the exemplary enzyme mix of the invention "E10 cocktail" to digest Jaygo 2 (5% solids) after 48 hr incubation (FIG. 95A) and subsequent acid hydrolysis of those liquors (FIG. 95B); as discussed in detail in Example 12, below.
Figure 95A:
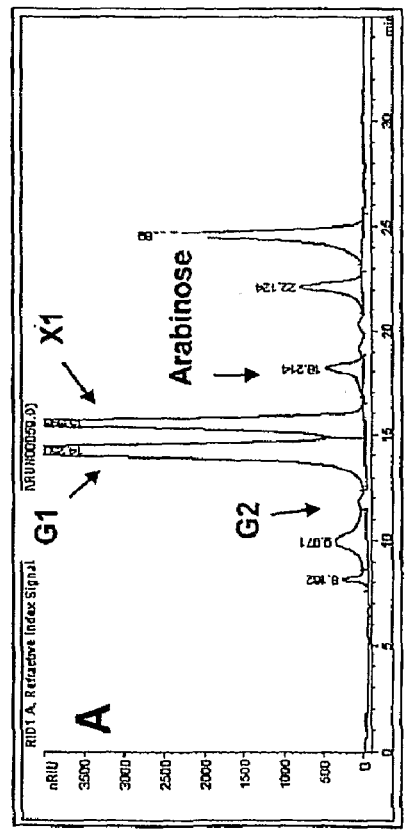

FIG. 95 illustrates chromatograms of the results of using the exemplary "E10 cocktail" enzyme mix of the invention to digest Jaygo 2 (5% solids) after 48 hr incubation (FIG. 95A) and subsequent acid hydrolysis of those liquors (FIG. 95B). This table shows the concentrations of sugar represented in each chromatogram as well as the percent theoretical conversion (based on approximately 118 mM as 100%):

|  | Enzyme | Post Acid |
|---|---|---|
| Glucose | 95 mM | 104 mM |
| (% theoretical) | (81) | (88) |
| Xylose | 80 mM | 103 mM |
| (% theoretical) | (68) | (87) |
| Mannose | — | 1.5 mM |
| Galactose | — | 4 mM |
| Arabinose | 11 mM | 14 mM |

Following acid hydrolysis the level of sugar release increased to almost 90% indicating that a majority of the sugars were in the soluble form but for some reason were not be completely degraded to monomer.

In order to aid in the discovery of enzymes that could act on the recalcitrant oligosaccharides, we set out to more carefully analyze the hydrolysate. Mass spectrometry was used to further characterize the oligomeric region of E10 and SPEZYME® cellulase/MULTIFECT® xylanase generated liquors. These data indicated that SPEZYME® cellulase/MULTIFECT® xylanase produced complex cello- and xylo-oligomers whereas the exemplary "E10 cocktail" enzyme mix of the invention mainly produced a tetrameric oligomer of pentose sugars and a trimer of mixed pentose and hexose sugars. The exemplary E10 cocktail enzyme mix saccharified liquors were fractionated using either the BioRad or SHO-DEX™ column (Thomson Instruments, Clear Brook, Va.) and samples were collected for more detailed analysis. The oligomeric region was divided separately into 4 different fractions (Peak 1, 2, 2.5 and 3 in FIG. 96), which illustrates an HPLC of fractionated E10 saccharification liquors.

Figure 96:
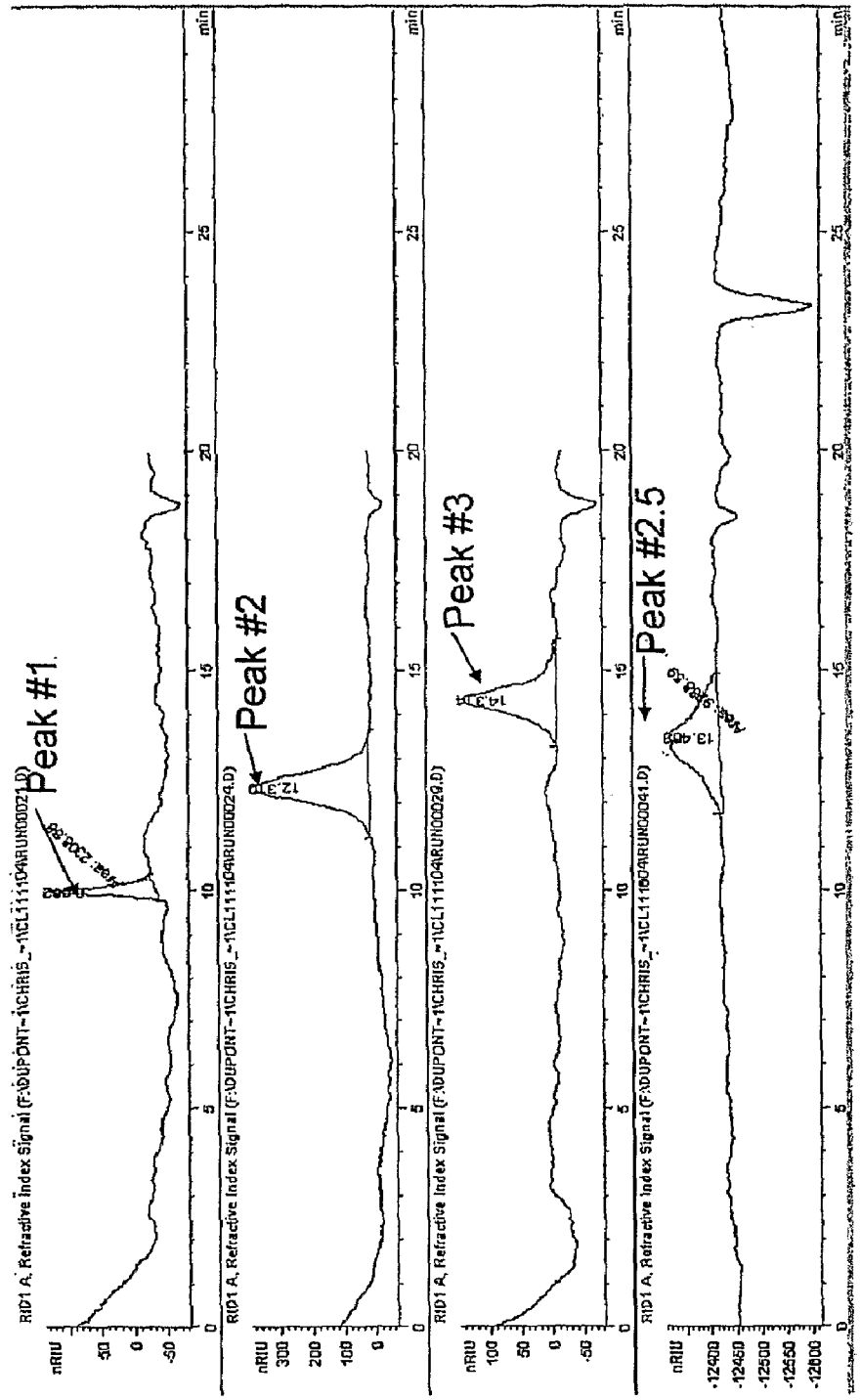
FIG. 96 illustrates an HPLC of fractionated E10 enzyme mix-derived saccharification liquors; as discussed in detail in Example 12, below.
Figure 97:
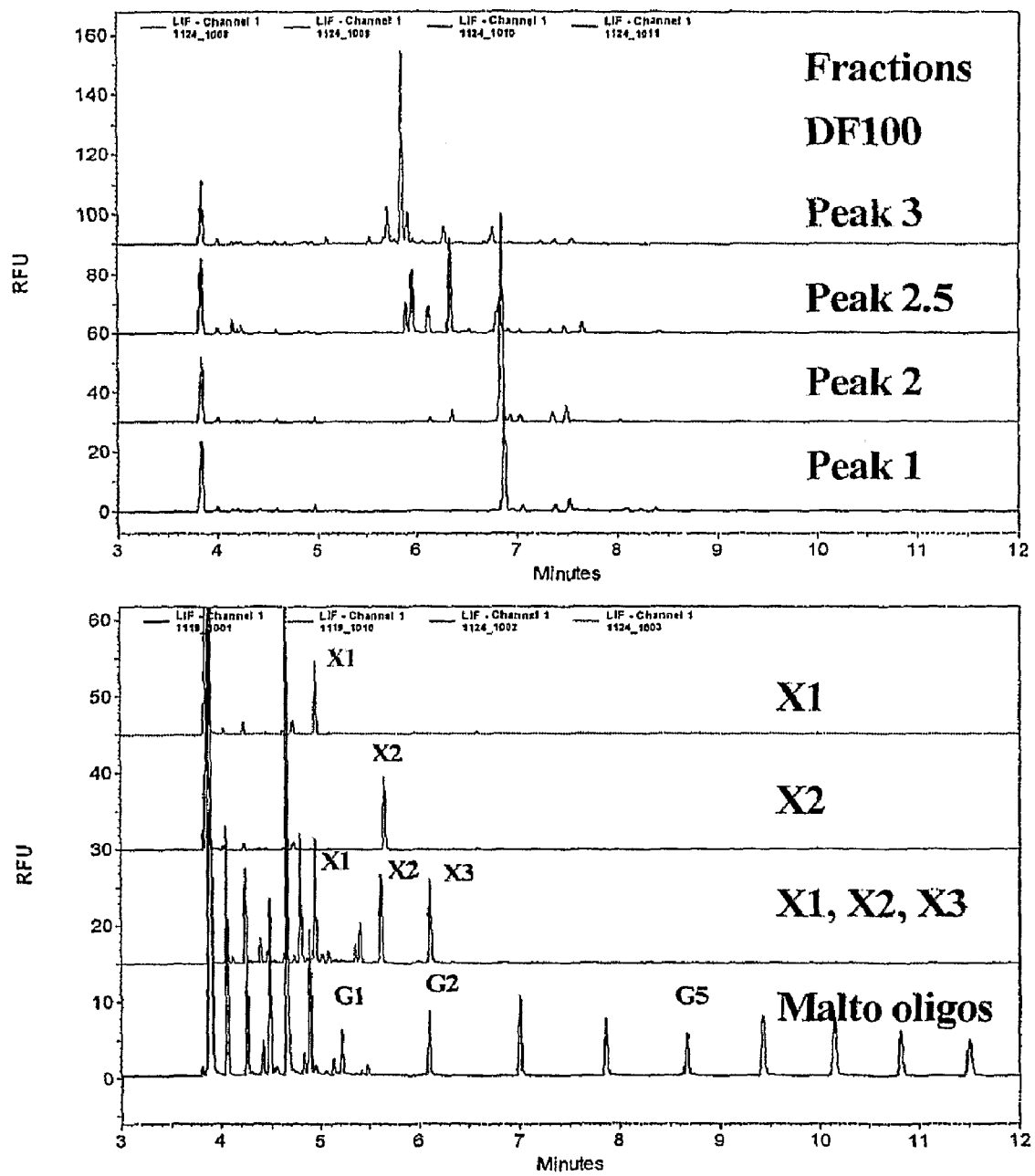
FIG. 97 illustrates the results of a capillary electrophoresis of the fractionation of E10 enzyme mix-digested saccharification liquors (upper panel); the lower panel contains standard mono- and oligosaccharides; as discussed in detail in Example 12, below.

Capillary electrophoresis analysis of the individual samples, as illustrated in FIG. 96, and this table:

|  | Peak 1 | Peak 2 | Peak 2.5 | Peak 3 |
|---|---|---|---|---|
| Xyl | 47.5 | 60.9 | 35.1 | 19.3 |
| Ara | 26.0 | 27.1 | 11.9 | 4.6 |
| Glu | 15.6 | 7.9 | 48.3 | 72.0 |
| Gal | 10.9 | 4.2 | 4.7 | 4.1 | suggested that each peak contained a major oligosaccharide. Acid hydrolysis of these fractions indicated that peak 1 and 2 are composed of mainly arabinose and xylose while peak 2.5 and 3 are mainly glucose. LC-MS of each of these fractions concluded that peak 2 is consistent with a tetramer of C-5 sugars. Coupled with the CE and HPLC of acid hydrolyzed fractions we concluded that the major component in the unhydrolyzed material was an arabinoxylan composed of 3 xylose and 1 arabinose molecules or "$AX_3$". FIG. 97 illustrates the results of a capillary electrophoresis of the fractionation of E10 enzyme mix-digested saccharification liquors (upper panel). The lower panel contains standard mono- and oligosaccharides. Percent xylose, arabinose, glucose and galactose in each peak as determined by the CE data in FIG. 81.

Overexpression of Enzyme Encoding Genes of the Invention

In one aspect, filamentous fungi, such a fungi of the genus Cochliobolus, e.g., the filamentous fungus Cochliobolus heterostrophus, are used as an expression system to express enzymes of the invention because, for example, a filamentous fungus system can satisfy a requirement for glycosylation of cellobiohydrolases, if desired, and they lack endogenous cellulase and hemicellulase activity. These enzyme systems of the invention can produce larger quantities of protein, including in one aspect secreting large quantities of enzymes of the invention.

Studies of gene expression including mRNA analysis (single and global gene analysis) and active protein detection can be used to optimize expression systems. RT-PCR can be used to monitor steady state mRNA levels for specific genes during various times in the growth phase. The amount can be normalized to the total RNA and can be compared to a constitutively and highly expressed gene (e.g., EF1α). Message quantity can be expressed in the "cycle number" or $C_t$ value. Tables of the $C_t$ values vs time are shown below; the exemplary enzymes of the invention SEQ ID NO:98 (encoded, e.g., by SEQ ID NO:97), SEQ ID NO:34 (encoded, e.g., by SEQ ID NO:33) and SEQ ID NO:446 (encoded, e.g., by SEQ ID NO:445) are three recombinant cellobiohydrolases integrated in the melanin locus; and for these experiments the C. heterostrophus strains were grown on xylose as the carbon source. $C_t$ values of 19-20 are considered to be highly expressed.

| Sample | time | SEQ ID NO: 98 (encoded by SEQ ID NO: 97) | | SEQ ID NO: 34 (encoded by SEQ ID NO: 33) | | SEQ ID NO: 446 (encoded by SEQ ID NO: 445) | |
|---|---|---|---|---|---|---|---|
| | | Ct Mean | Ct Std Dev | Ct Mean | Ct Std Dev | Ct Mean | Ct Std Dev |
| CBH | 24 | 19.5 | 0.09 | 20.7 | 0.10 | 21.3 | 0.08 |
| | 48 | 20.4 | 0.09 | 21.1 | 0.01 | 21.8 | 0.11 |
| | 72 | 20.5 | 0.06 | 20.5 | 0.03 | 23.4 | 0.13 |
| | 96 | 20.3 | 0.06 | 19.7 | 0.01 | 21.8 | 0.11 |
| | 120 | 19.8 | 0.06 | 20.6 | 0.04 | 20.6 | 0.04 |
| EF1-α | 24 | 19.1 | 0.59 | 19.0 | 0.14 | 19.7 | 0.04 |
| | 48 | 19.8 | 0.12 | 19.7 | 0.02 | 20.1 | 0.06 |
| | 72 | 20.8 | 0.05 | 19.8 | 0.08 | 21.7 | 0.07 |
| | 96 | 20.8 | 0.08 | 19.5 | 0.04 | 20.1 | 0.01 |
| | 120 | 20.0 | 0.03 | 19.4 | 0.02 | 19.2 | 0.06 |

Message levels for the non-CBH genes are lower than the CBH genes as seen in the table below. As a point of reference a Ct of 1 corresponds to a 2-fold difference in messenger concentration. In particular, exemplary enzyme of the invention SEQ ID NO:106 (encoded, e.g., by SEQ ID NO:105) has a Ct number of about 26, much higher than the others.

|     |      |                                  | Bacterial Enzymes | | EF1-alpha | |
| --- | ---- | -------------------------------- | ------- | ------- | ------- | ------- |
| No. | time | Name                             | Ct Mean | Ct Std Dev | Ct Mean | Ct Std Dev |
| 1   | 24   | SEQ ID NO: 264 (encoded by SEQ ID NO: 261) | 22.0 | 0.01 | 22.3 | 0.54 |
| 2   | 72   | SEQ ID NO: 264 (encoded by SEQ ID NO: 261) | 23.0 | 0.05 | 22.2 | 0.16 |
| 3   | 24   | SEQ ID NO: 100 (encoded by SEQ ID NO: 99)  | 24.2 | 0.23 | 20.8 | 0.05 |
| 4   | 72   | SEQ ID NO: 100 (encoded by SEQ ID NO: 99)  | 25.7 | 0.26 | 22.0 | 0.04 |
| 5   | 24   | SEQ ID NO: 96 (encoded by SEQ ID NO: 95)   | 23.1 | 0.06 | 20.5 | 0.08 |
| 6   | 72   | SEQ ID NO: 96 (encoded by SEQ ID NO: 95)   | 22.1 | 0.07 | 20.9 | 0.07 |
| 7   | 24   | SEQ ID NO: 106 (encoded by SEQ ID NO: 105) | 26.4 | 0.11 | 20.6 | 0.19 |
| 8   | 72   | SEQ ID NO: 106 (encoded by SEQ ID NO: 105) | 26.5 | 0.07 | 21.9 | 0.02 |
| 9   | 24   | SEQ ID NO: 92 (encoded by SEQ ID NO: 91)   | 21.5 | 0.02 | 22.5 | 0.06 |
| 10  | 72   | SEQ ID NO: 92 (encoded by SEQ ID NO: 91)   | 22.1 | 0.03 | 21.1 | 0.06 |
| 11  | 24   | Mel-KO                           |         |         | 21.3 | 0.02 |
| 12  | 72   | Mel-KO                           |         |         | 21.5 | 0.02 |

Use of Pectinases in Enzyme Cocktails of the Invention

The invention provides enzyme cocktails comprising pectinase enzymes, including enzymes of the invention having pectinase activity. Addition of pectinase to the exemplary enzyme mix of the invention, including the "E8 cocktail", improved glucose yields by 5-6% from Jaygo 2 samples. Far less cellobiose accumulated during saccharification of 5 and 10% solids (Jaygo 2) when the exemplary β-glucosidase SEQ ID NO:94 (encoded, e.g., by SEQ ID NO:93) was used in the cocktail instead of SEQ ID NO:264 (encoded, e.g., by SEQ ID NO:263). When *Cochliobolus* grown using a biomass sample as the carbon source instead of glucose approximately 4000 genes are differentially expressed.

Enzyme stability to ethanol was tested by performing saccharification reactions in the presence of 1, 2 and 5% ethanol. The exemplary enzyme mix of the invention E8 cocktail (18 mg/g cellulose) was used with 10% solids (Jaygo 2). The table below shows the amount of glucose and xylose released at 48 hrs from each of the reactions. As the ethanol concentration is increased there is an overall drop in sugar yields, though glucose is more affected than xylose.

| EtOH % | G1-48 hr | X1-48 hr |
| ------ | -------- | -------- |
| 0%     | 59       | 66       |
| 1%     | 57       | 65       |
| 2%     | 55       | 63       |
| 5%     | 49       | 63       |

Figure 98:
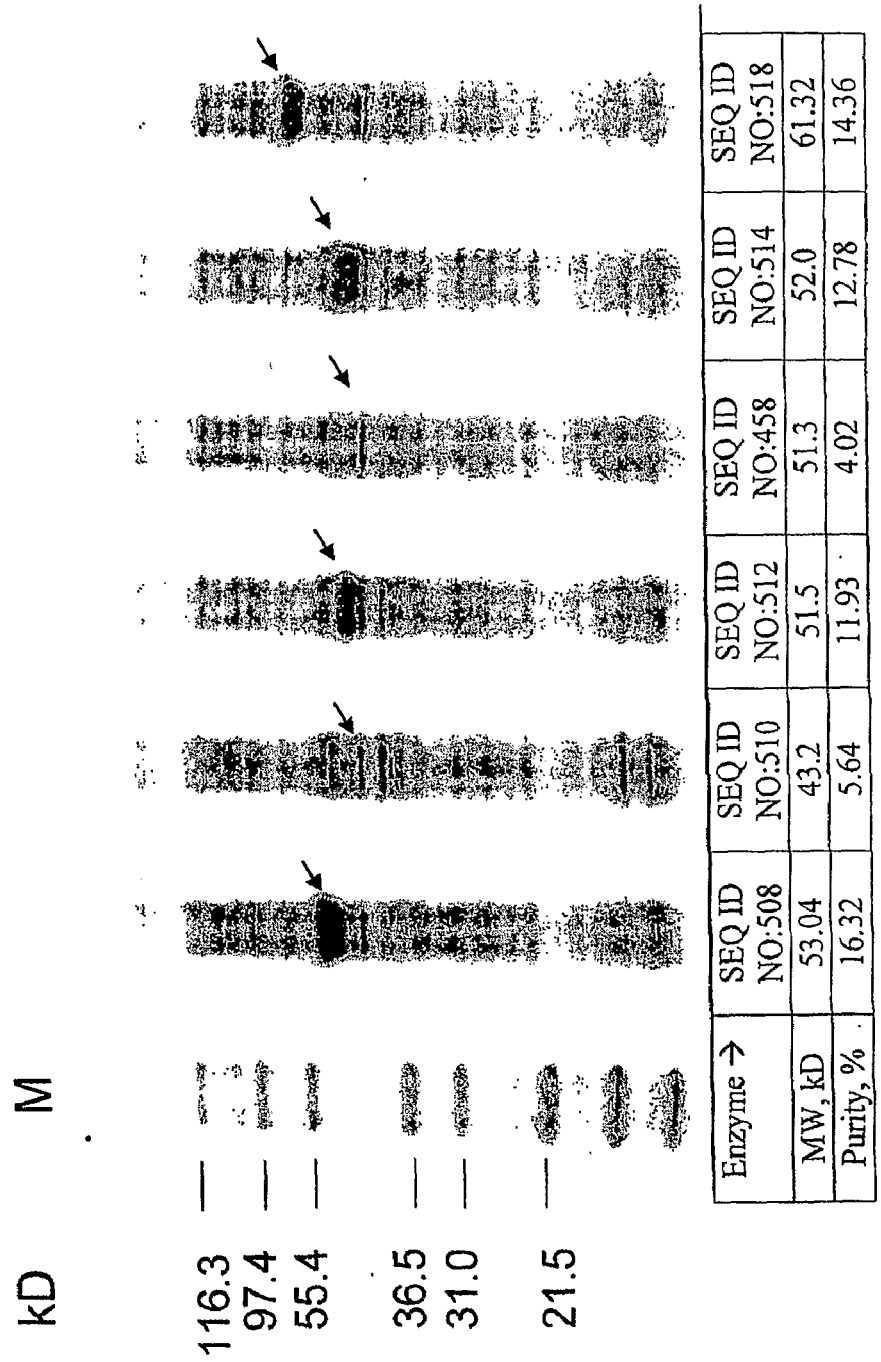
FIG. 98 illustrates an SDS-PAGE was done on the 6 pectinases tested in exemplary enzyme cocktails of the invention; as discussed in detail in Example 12, below.

The addition of pectinases (6 were tested) to the enzyme cocktails improved the yield of glucose from the saccharification of a Jaygo 2 sample (5% solids). The level of improvement observed was 5-6% over control reactions. Additional biochemistry was carried out to further characterize the enzymes. In particular, SDS-PAGE analysis was used to quantify the amount of pectinase that was used in the mixtures. As illustrated in FIG. 98, SDS-PAGE was done on the 6 pectinases tested in the E8 cocktails. 5 ug total protein was used in each lane. Percent purity was estimated based on densitometry.

At least in these assays, the most effective pectinase in the cocktail was the exemplary SEQ ID NO:458 (encoded, e.g., by SEQ ID NO:457) enzyme; addition of this enzyme to the enzyme cocktail E8 resulted in the greatest increase in glucose yield over the control (from 70% in the control to 76% with SEQ ID NO:458 (encoded, e.g., by SEQ ID NO:457) within 48 hrs). FIG. 98 shows that the exemplary SEQ ID NO:458 (encoded, e.g., by SEQ ID NO:457) only constituted approximately 4% of the total protein, though it resulted in the highest increase in glucose.

Saccharified liquor samples were fractionated, producing enough quantities of the recalcitrant oligosaccharides to screen. Acid hydrolysis of the fractionated material was consistent with previous data. Six family 51 arabinofuranosidases were subcloned, expressed and shown to be active on model, dye-labeled substrates.

CBH and β-Glucosidase Optimization

Figure 99:
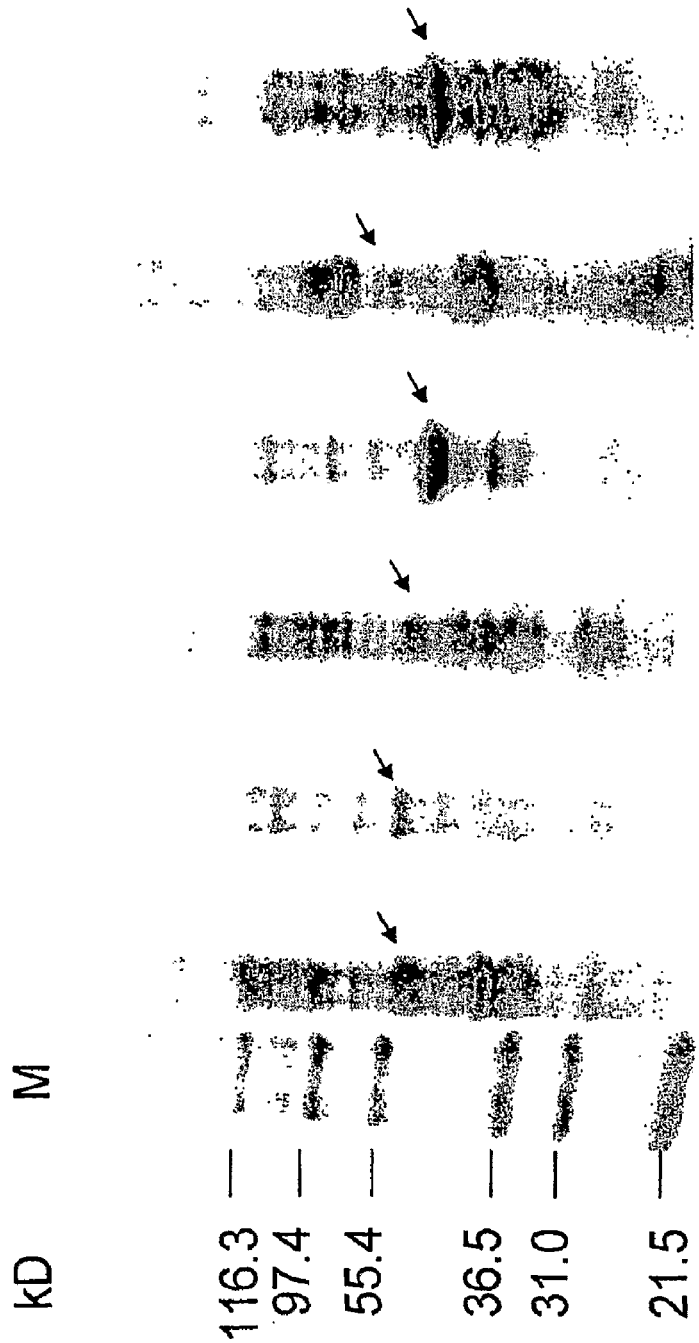
FIG. 99 illustrates an SDS-PAGE of six β-glucosidases tested in exemplary E8 cocktails of the invention; as discussed in detail in Example 12, below.

The E8 enzyme cocktails containing the exemplary β-glucosidase SEQ ID NO: 94 (encoded, e.g., by SEQ ID NO:93) accumulated less cellobiose (hence made more glucose) than cocktails containing the exemplary SEQ ID NO:264 (encoded, e.g., by SEQ ID NO:263). SDS-PAGE, as illustrated in FIG. 99, was used to normalize the protein amounts used in those cocktails. The exemplary SEQ ID NO:94 (encoded, e.g., by SEQ ID NO:93) contained almost 10 fold more enzyme than SEQ ID NO:264 (encoded, e.g., by SEQ ID NO:263), however less cellobiose accumulated when SEQ ID NO:94 (encoded, e.g., by SEQ ID NO:93) was used in the cocktail implying that the enzyme either has a higher specific activity or is less inhibited by product. FIG. 99 illustrates an SDS-PAGE of the six β-glucosidases tested in the E8 cocktails. 5 ug total protein was used in each lane. Percent purity was estimated based on densitometry.

In one aspect, the enzyme expressing genes of the invention are overexpressed, e.g., to improve protein secretion by the desired expression system, e.g., a fungal expression system, such as a *Cochliobolus* system. Mutants can be generated by both chemical and UV mutagenesis. A screening system has been developed and validated.

Study of the expression patterns of endogenous *Cochliobolus* glycosyl hydrolases also can be helpful in designing enzyme mixes of the invention. Expression can be repressed by glucose and xylose and induced by growth on biomass samples. Time courses of gene expression can be generated using real time RT-PCR. Directed mutations can be made in specific catabolite repressor and protease genes to study the effects on heterologous gene expression and protein production.

Very little performance loss is seen in the enzyme mix "E8" at 1% and 2% ethanol, though much greater loss was observed at 5% ethanol. Significant performance loss was observed at 60° C. mostly attributable to CBH instability. The exemplary SEQ ID NO:94 (encoded, e.g., by SEQ ID NO:93), a β-glucosidase, is expressed at very high levels in E. coli and at least in these assays is a better performer than SEQ ID NO:264 (encoded, e.g., by SEQ ID NO:263); thus, SEQ ID NO:94 (encoded, e.g., by SEQ ID NO:93) has become a standard β-glucosidase (bG) in the cocktail. Strain development of Cochliobolus can develop a hypersecretor with improved overall protein yields.

Regarding the impact of pectinase on cocktail performance, test results showed that a small (5-6% glucose increase) improvement in performance was obtained when pectinases were added to a 5% solids reaction. However, no obvious improvement was observed in reactions that contained 10% solids; there was no apparent dose response. Our conclusion was that the addition of a pectinase to the current cocktails provides no real benefit—at least with respect to these assay systems.

Figure 100:
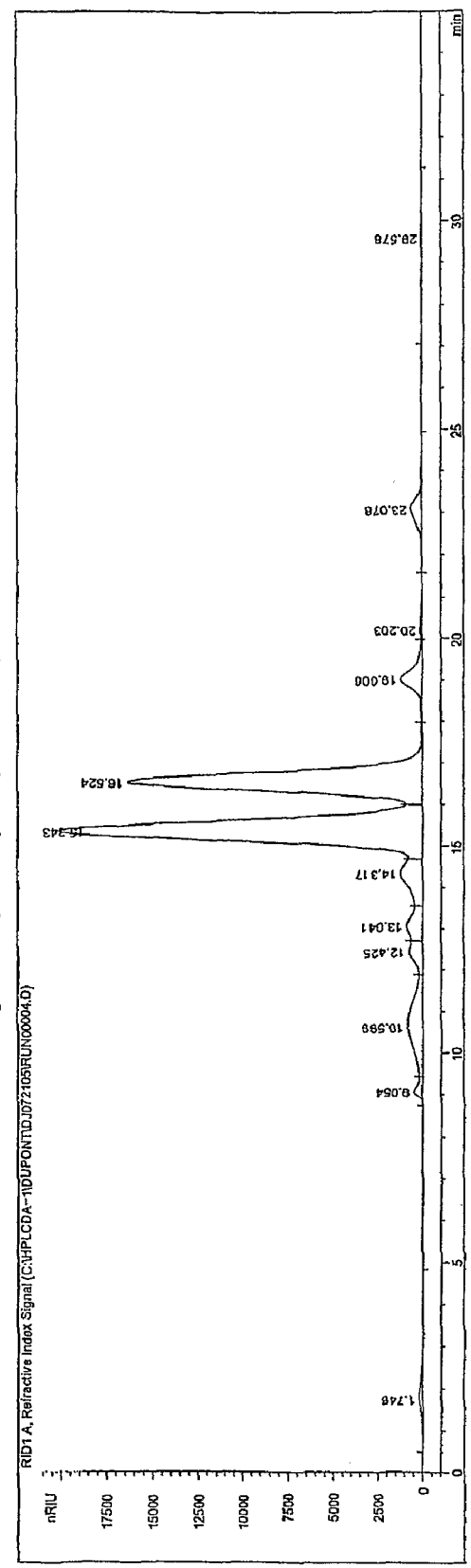
FIG. 100 is an illustration of an HPLC-RI trace of the unfractionated saccharification liquors showing the recalcitrant oligosaccharides (F2), cellobiose (CB), glucose (G), xylose (X) and arabinose (A); as discussed in detail in Example 12, below.
Figure 101:
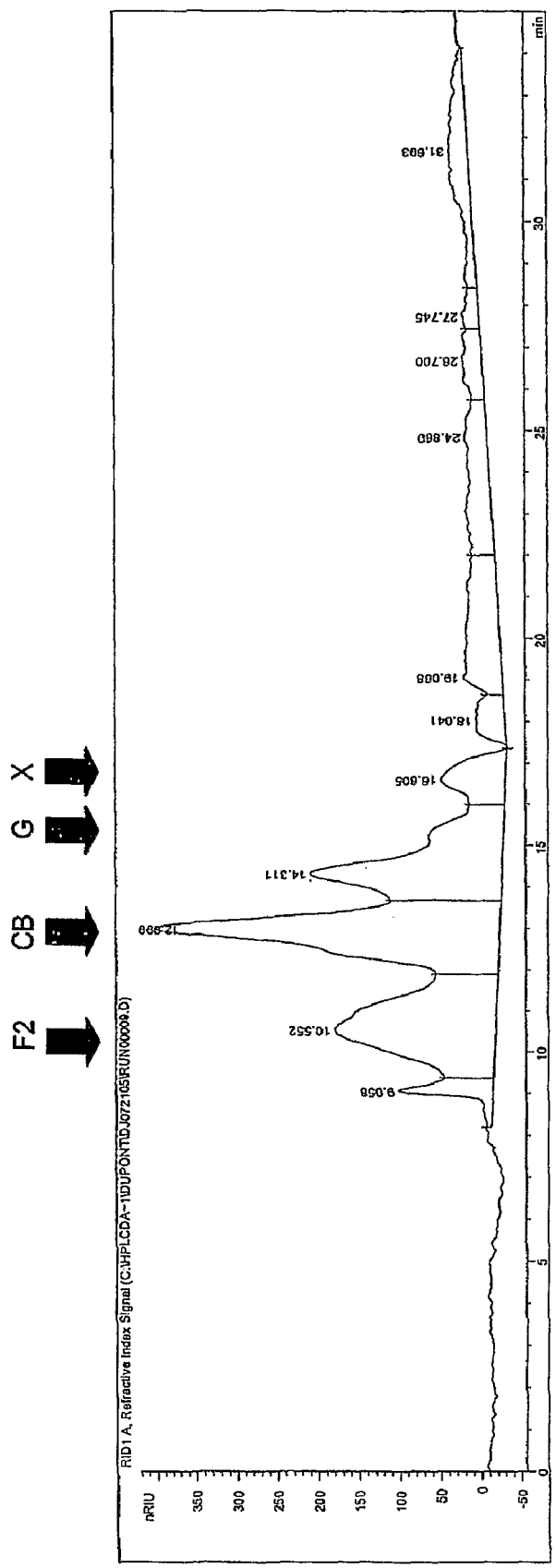
FIG. 101 illustrates an HPLC-RI trace of the fractionated saccharification liquors showing the recalcitrant oligosaccharides (F2), cellobiose (CB), glucose (G), xylose (X) and arabinose (A); as discussed in detail in Example 12, below.

Five new family 51 arabinofuranosidases were subcloned: the exemplary enzymes of the invention SEQ ID NO:460 (encoded, e.g., by SEQ ID NO:459), SEQ ID NO:462 (encoded, e.g., by SEQ ID NO:461), SEQ ID NO:464 (encoded, e.g., by SEQ ID NO:463), SEQ ID NO:466 (encoded, e.g., by SEQ ID NO:465) and SEQ ID NO:468 (encoded, e.g., by SEQ ID NO:467). These five enzymes tested positive for activity on 4-M-arabinofuranoside. These five enzymes plus 11 family 51 arabinofuranosidases were tested for their ability to degrade partially purified $AX_3$; thus, this exemplary mix of the invention comprises: SEQ ID NO:470 (ENCODED, E.G., BY SEQ ID NO:469), SEQ ID NO:472 (ENCODED, E.G., BY SEQ ID NO:471), SEQ ID NO:474 (ENCODED, E.G., BY SEQ ID NO:473), SEQ ID NO:476 (ENCODED, E.G., BY SEQ ID NO:475), SEQ ID NO:478 (ENCODED, E.G., BY SEQ ID NO:477), SEQ ID NO:480 (ENCODED, E.G., BY SEQ ID NO:479), SEQ ID NO:482 (ENCODED, E.G., BY SEQ ID NO:481), SEQ ID NO:484 (ENCODED, E.G., BY SEQ ID NO:483), SEQ ID NO:486 (ENCODED, E.G., BY SEQ ID NO:485), SEQ ID NO:488 (ENCODED, E.G., BY SEQ ID NO:487) and SEQ ID NO:490 (ENCODED, E.G., BY SEQ ID NO:489). A saccharified liquor from a SPEZYME cellulase/hemicellulase reaction was used. A chromatogram of the unfractionated mixture is shown in FIG. 100, an illustration of an HPLC-RI trace of the unfractionated saccharification liquors showing the recalcitrant oligosaccharides (F2), cellobiose (CB), glucose (G), xylose (X) and arabinose (A). The sample was treated with glucose oxidase to remove glucose and xylose monomer resulting in the sample, as shown in FIG. 101; an HPLC-RI trace of the fractionated saccharification liquors showing the recalcitrant oligosaccharides (F2), cellobiose (CB), glucose (G), xylose (X) and arabinose (A).

Figure 102:
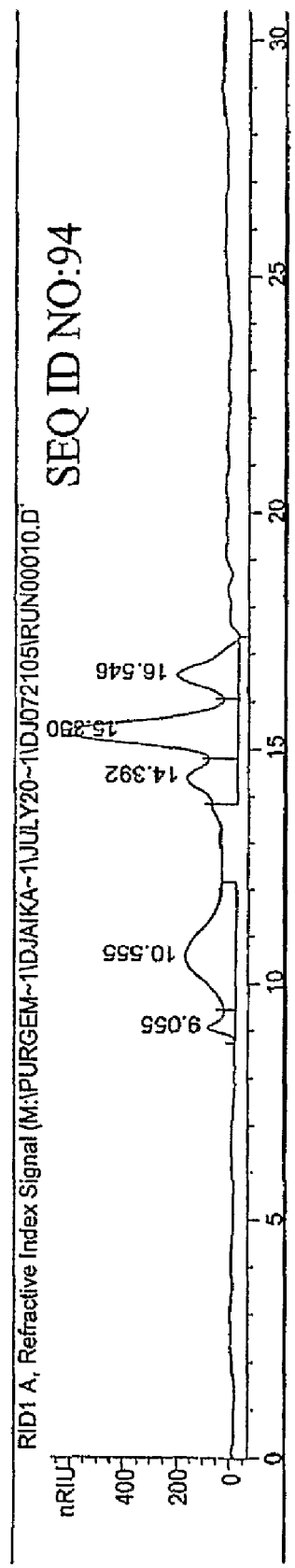
FIG. 102 illustrates an HPLC-RI trace of the sample shown in FIG. 101 with exemplary enzymes of the invention; as discussed in detail in Example 12, below.

When this sample is treated with the exemplary enzymes of the invention β-glucosidase SEQ ID NO:94 (ENCODED, E.G., BY SEQ ID NO:93) and β-xylosidase SEQ ID NO:96 (ENCODED, E.G., BY SEQ ID NO:95), glucose appeared and major reduction in the "F2" region was observed (as illustrated in FIG. 102) indicating that this region of the chromatogram contained cellooligomers of various chain lengths. The new F2 region became very symmetrical and appeared to be a single species. FIG. 102 illustrates an HPLC-RI trace of the sample shown in FIG. 101 with the exemplary enzymes SEQ ID NO:94 (ENCODED, E.G., BY SEQ ID NO:93) and SEQ ID NO:96 (ENCODED, E.G., BY SEQ ID NO:95). Four enzymes showed some activity in degrading "fraction 2" (recalcitrant xylo-oligomers) and generating arabinose: the exemplary enzymes of the invention SEQ ID NO:482 (ENCODED, E.G., BY SEQ ID NO:481), SEQ ID NO:478 (ENCODED, E.G., BY SEQ ID NO:477), SEQ ID NO:484 (ENCODED, E.G., BY SEQ ID NO:483), SEQ ID NO:486 (ENCODED, E.G., BY SEQ ID NO:485).

Figure 103:
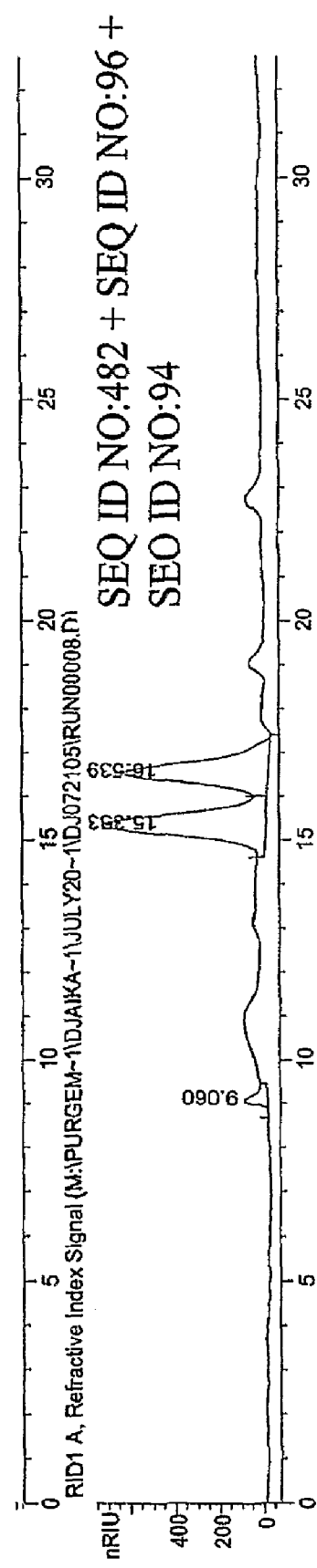
FIG. 103 illustrates an HPLC-RI trace of the sample shown in FIG. 102 with the exemplary arabinofuranosidase; as discussed in detail in Example 12, below.

Treatment of the sample shown in FIG. 102 with the exemplary arabinofuranosidase SEQ ID NO:482 (ENCODED, E.G., BY SEQ ID NO:481) resulted in almost complete loss of the of the peak at approx. 10.5 minutes and subsequent increase in xylose and arabinose, as illustrated in FIG. 103, an HPLC-RI trace of the sample shown in FIG. 102 with the exemplary arabinofuranosidase SEQ ID NO:482 (ENCODED, E.G., BY SEQ ID NO:481). The conclusion from these data is that the family 51 arabinofuranosidase SEQ ID NO:482 (ENCODED, E.G., BY SEQ ID NO:481) in combination with the exemplary enzymes of the invention β-xylosidase SEQ ID NO:96 (ENCODED, E.G., BY SEQ ID NO:95) and β-glucosidase SEQ ID NO:94 (ENCODED, E.G., BY SEQ ID NO:93) is able to digest the majority of the recalcitrant oligosaccharides to monomer glucose and xylose.

In one aspect, to optimize expression systems, chemical (EMS) and UV mutagenesis of cell systems, e.g., fungal systems, such as Cochliobolus, can be done. Approximately 1400 mutants were screened for increased xylanase and β-glucosidase activity. Close to 60 hits were observed of which approximately 10 were reconfirmed after secondary screening.

Targeted deletion of catabolite repressor genes have resulted in an increase in protein production. Alternative secretion signals can be tested with enzymes of the invention, e.g., heterologous secretion signals (in addition to or with heterologous leader or signal sequences) can be spliced onto enzymes of the invention, e.g., the exemplary CBH genes SEQ ID NO:34 (ENCODED, E.G., BY SEQ ID NO:33) and SEQ ID NO:98 (ENCODED, E.G., BY SEQ ID NO:97).

In summary, sixteen family 51 arabinofuranosidases were tested for the ability to digest the recalcitrant xylo-oligomers ("fraction 2") from the saccharified liquors. The exemplary enzyme of the invention SEQ ID NO:482 (ENCODED, E.G., BY SEQ ID NO:481) in combination with the β-glucosidase (bG) SEQ ID NO:94 (ENCODED, E.G., BY SEQ ID NO:93) and bX SEQ ID NO:96 (ENCODED, E.G., BY SEQ ID NO:95) converted "fraction 2" into xylose, glucose and arabinose, though at a relatively slow rate. Thus, in one aspect, a family 3 carbohydrate binding domain is appended to the exemplary endoglucanase SEQ ID NO:106 (ENCODED, E.G., BY SEQ ID NO:105).

In one aspect, the invention provides methods for modifying the sequences of exemplary enzymes of the invention with a goal of, e.g., modifying activity, such as increasing activity under specific environmental conditions, such as high temperature or pH, high salt conditions, high substrate concentrations, e.g., by evolution using Gene Site Saturation Mutagenesis (GSSM, discussed above) technology, e.g., of the exemplary enzyme of the invention CBH SEQ ID NO:34 (ENCODED, E.G., BY SEQ ID NO:33).

Figure 104:
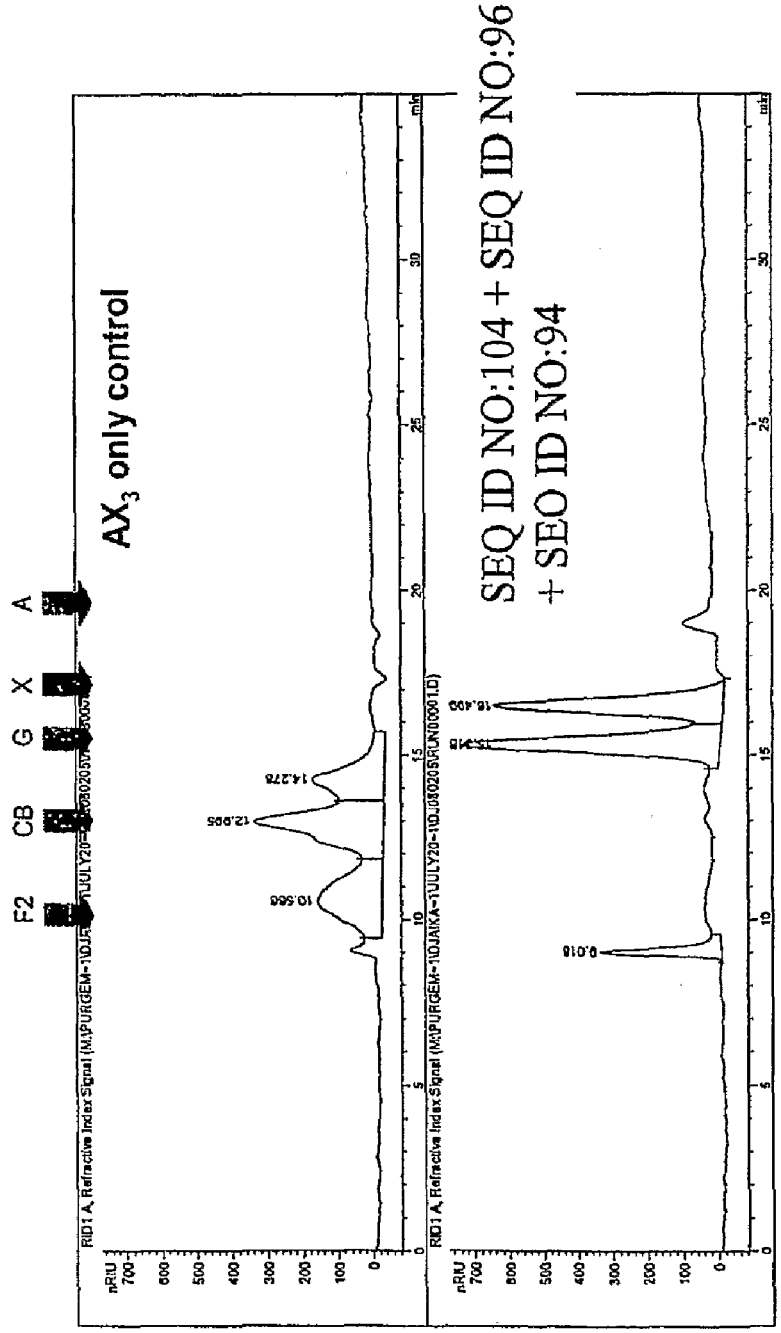
FIG. 104 illustrates an HPLC analysis of the digestion of fractionated soluble oligomers (AX$_3$) by the exemplary enzymes of the invention; as discussed in detail in Example 12, below.

Additional enzymes were tested for the ability to degrade "fraction 2". One enzyme in particular, SEQ ID NO:104 (ENCODED, E.G., BY SEQ ID NO:103) in combination with the bG SEQ ID NO: 94 (ENCODED, E.G., BY SEQ ID NO:93) and the bX SEQ ID NO:96 (ENCODED, E.G., BY SEQ ID NO:95), converted nearly all the AX₃ present in fraction 2 to xylose and arabinose, as illustrated in FIG. 104. FIG. 104 illustrates an HPLC analysis of the digestion of fractionated soluble oligomers (AX₃) by the exemplary enzymes of the invention: SEQ ID NO:104 (ENCODED, E.G., BY SEQ ID NO:103), a family 62 arabinofuranosidase; SEQ ID NO:96 (ENCODED, E.G., BY SEQ ID NO:95) (bX); and, SEQ ID NO:94 (ENCODED, E.G., BY SEQ ID NO:93) (bG). In FIG. 104, the top panel is substrate only and the bottom panel is after 14 hr enzyme incubation. The identities of each peak are shown above (F2: fraction 2, CB: cellobiose, G: glucose, X: xylose and A: arabinose).

The enzyme SEQ ID NO:104 (ENCODED, E.G., BY SEQ ID NO:103), a family 62 arabinofuranosidase (a *Cochliobolus* enzyme), was expressed in *Pichia pastoris*. This enzyme SEQ ID NO:104 (ENCODED, E.G., BY SEQ ID NO:103) was used to process an unfractionated hydrolysate. Though almost complete conversion took place, the rate was much slower than the reaction described above for FIG. 104 (degrading "fraction 2" with SEQ ID NO:104 (ENCODED, E.G., BY SEQ ID NO:103); SEQ ID NO:96 (ENCODED, E.G., BY SEQ ID NO:95) (bX); and, SEQ ID NO:94 (ENCODED, E.G., BY SEQ ID NO:93)). In order to investigate whether the decreased rate was due to high concentrations of monomer sugars (glucose and xylose) in the hydrolysate, the fractionated material was spiked with either glucose or xylose or both at concentrations equivalent to what is found in the original material. Under these conditions we observed equivalent performance to the fractionated material, suggesting that glucose and xylose in and of themselves did not inhibit SEQ ID NO:104 (ENCODED, E.G., BY SEQ ID NO:103), and that some other compound(s) must be the source of inhibition.

Both glucose and xylose yields from Jaygo 2 (5% solids) benefited from the addition of the arabinofuranosidase SEQ ID NO:104 (ENCODED, E.G., BY SEQ ID NO:103) (1 mg/ml protein concentration) to the E8 cocktail of the invention (18 mg enzyme/g, *T. reesei* CBH I and II). Chromatograms still showed the presence of some fraction 2.

| | Glucose (% at 48 hrs) | Xylose (% at 48 hrs) |
|---|---|---|
| E8 | 77 | 66 |
| E8 + SEQ ID NO: 104 (encoded, e.g., by SEQ ID NO: 103) | 82 | 70 |

Figure 105:
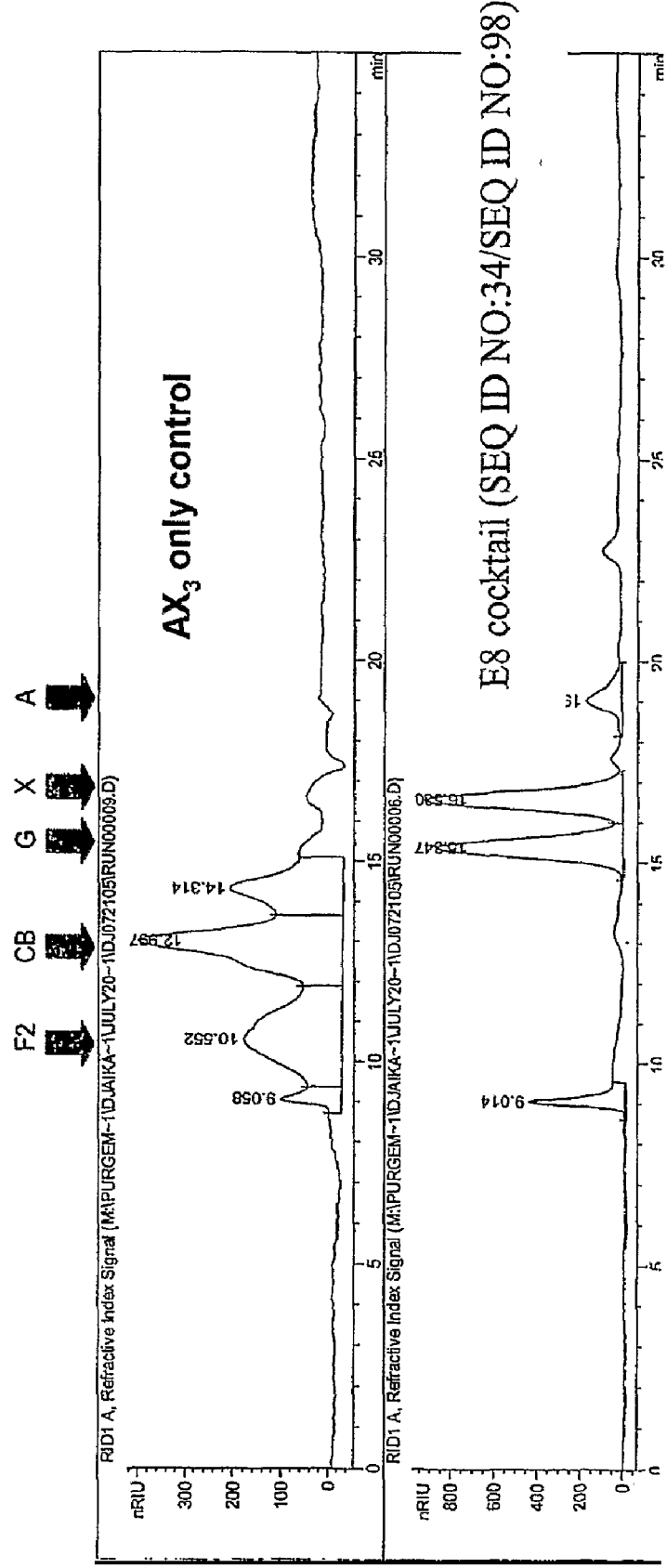
FIG. 105 illustrates data showing digestion of fractionated soluble oligomers (AX$_3$) by an E8 cocktail of the invention comprising the exemplary enzymes SEQ ID NO:34 (encoded by, e.g., SEQ ID NO:33) and SEQ ID NO:98 (encoded by, e.g., SEQ ID NO: 97); the top panel is substrate only and the bottom panel is after 14 hr enzyme incubation; as discussed in detail in Example 12, below.

Interestingly when the fractionated oligomeric sugars were incubated with the E8 cocktail which contained the cellobiohydrolases of the invention SEQ ID NO:34 (encoded, e.g., by SEQ ID NO:33) and SEQ ID NO:98 (encoded, e.g., by SEQ ID NO:97), we observed almost complete conversion of fraction 2 to glucose and xylose, as illustrated in the HPLC data plot of FIG. 105. FIG. 105 illustrates data showing digestion of fractionated soluble oligomers (AX₃) by the E8 cocktail that contained the exemplary enzymes SEQ ID NO:34 (encoded, e.g., by SEQ ID NO:33) and SEQ ID NO:98 (encoded, e.g., by SEQ ID NO:97). The top panel is substrate only and the bottom panel is after 14 hr enzyme incubation. The identities of each peak are shown above (F2: fraction 2, CB: cellobiose, G: glucose, X: xylose and A: arabinose).

Further experimentation revealed that the SEQ ID NO:34 (encoded, e.g., by SEQ ID NO:33) preparation contained the activity responsible for the conversion. SEQ ID NO:34 (encoded, e.g., by SEQ ID NO:33) is a heterologously expressed CBH produced in *Cochliobolus*. This particular preparation is an ammonium sulfate fractionation, therefore, it contains other enzymes secreted by *Cochliobolus*. Proteomics analysis of the sample showed that it contained at least 37 other proteins. Included are 2 xylanases, 1 ferulic acid esterase, 1 xylosidase and 2 arabinofuranosidases. Thus, one or more of these proteins most likely is responsible for the observed effect.

Endoglucanase (EG) Optimization

Several variants of SEQ ID NO:106 (encoded, e.g., by SEQ ID NO:105), also called EG1, have been constructed; these include the exemplary enzymes of the invention EG1_CD, EG1_CDDDED, EG1_CDCBM3 (for example, EG1_CDDDED comprises SEQ ID NO:106 (encoded, e.g., by SEQ ID NO:105) with an esterase domain, a carbohydrate binding domain):

| Clone | Description |
|---|---|
| EG1 | EG Catalytic domain, dockerin domains* (original EG in E8) |
| EG1_CD | EG Catalytic domain |
| EG1_CDDDED | EG Catalytic domain, dockerin domains, esterase domain |
| EG1_CDCBM3 | EG Catalytic domain, CBM3 |

(*dockerin domains are cohesin domains on cellulosomal scaffolding proteins, see, e.g., Leibovitz (1996) J. Bacteriol. 178: 3077-3084; Leibovitz (1997) J. Bacteriol. 179(8): 2519-2523.

SDS-PAGE analysis showed that expression levels of each of the variants were higher than the original construct, SEQ ID NO:106 (encoded, e.g., by SEQ ID NO:105). The performance of each in the E8 cocktail was assessed. Enzyme loadings were normalized based on estimated expression levels from SDS-PAGE analysis. The table below details the yields of glucose and xylose after 48 hr reaction on Jaygo 2 and a loading of 18 mg/g cellulose (5% solids). The data shown in the table are the average of 2 independent experiments with standard deviations ≦2%:

| Variant | % Glucose | % Xylose |
|---|---|---|
| SEQ ID NO: 106 (encoded, e.g., by SEQ ID NO: 105) | 74 | 64 |
| EG1_CD | 74 | 64 |
| EG1_CDDDED | 77 | 67 |
| EG1_CDCBM3 | 81 | 70 |

The data suggest that appending a carbohydrate binding domain to the endoglucanase had a positive effect on the yield of glucose.

Overexpression Systems

Figure 106:
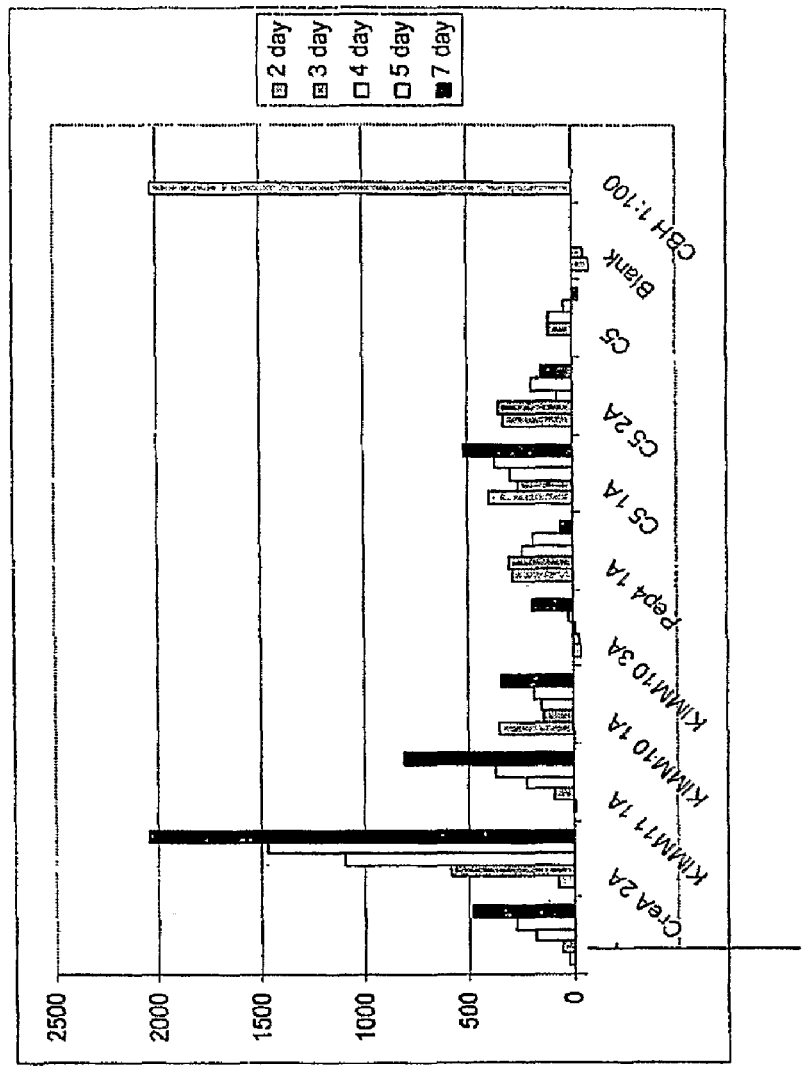
FIG. 106 graphically illustrated the hydrolysis of PASC by secreted enzyme SEQ ID NO:34 (encoded by, e.g., SEQ ID NO:33) of various gene knockouts.

The enzymes of the invention can be expressed using any host cell. Host cell systems can be optimized to generate overexpression/high expression systems. Deletion of the catabolite repression gene, creA, in a *Cochliobolus* host cell appeared to have a positive impact on the expression level of the exemplary enzyme SEQ ID NO:34 (encoded, e.g., by SEQ ID NO:33) (50 mL shake flask). PASC hydrolysis by secreted protein was much higher in the *Cochliobolus* creA mutant than in the *Cochliobolus* controls and the other *Cochliobolus* strains, as illustrated in FIG. 106. This reaction can also be done in 30 L fermenters. FIG. 106 graphically illustrated the hydrolysis of PASC by secreted enzyme SEQ ID NO:34 (encoded, e.g., by SEQ ID NO:33) of various gene knockouts.

In summary, the *Cochliobolus* enzyme SEQ ID NO:104 (encoded, e.g., by SEQ ID NO:103) (family 62 arabinofuranosidase) in combination with bG SEQ ID NO:94 (encoded, e.g., by SEQ ID NO:93) and bX SEQ ID NO:96 (encoded, e.g., by SEQ ID NO:95) converted the recalcitrant xylo-oligosaccharides into xylose, glucose and arabinose. Addition of SEQ ID NO:104 (encoded, e.g., by SEQ ID NO:103) to the E8 cocktail showed an increase in the level of glucose and xylose monomer. Furthermore a contaminating protein(s) in the SEQ ID NO:34 (encoded, e.g., by SEQ ID NO:33) (CBH I) preparation also converted the recalcitrant material into monomer sugar. Several variations of CBM—endoglucanase (EG), e.g., SEQ ID NO:106 (encoded, e.g., by SEQ ID NO:105), combinations were constructed and had a positive affect on the release of glucose from Jaygo 2. At least in these assays, the best construct was EG1_CDCBM3 with a "family 3" cellulose-binding module (CBM) appended to the C-terminus of the catalytic domain. In one aspect, enzyme sequences of the invention are "evolved" by a sequence mutation technology, e.g., GSSM technology; for example, the cellobiohydrolase SEQ ID NO:34 (encoded, e.g., by SEQ ID NO:33) sequence is modified using GSSM.

Hemicellulases

Figure 107:
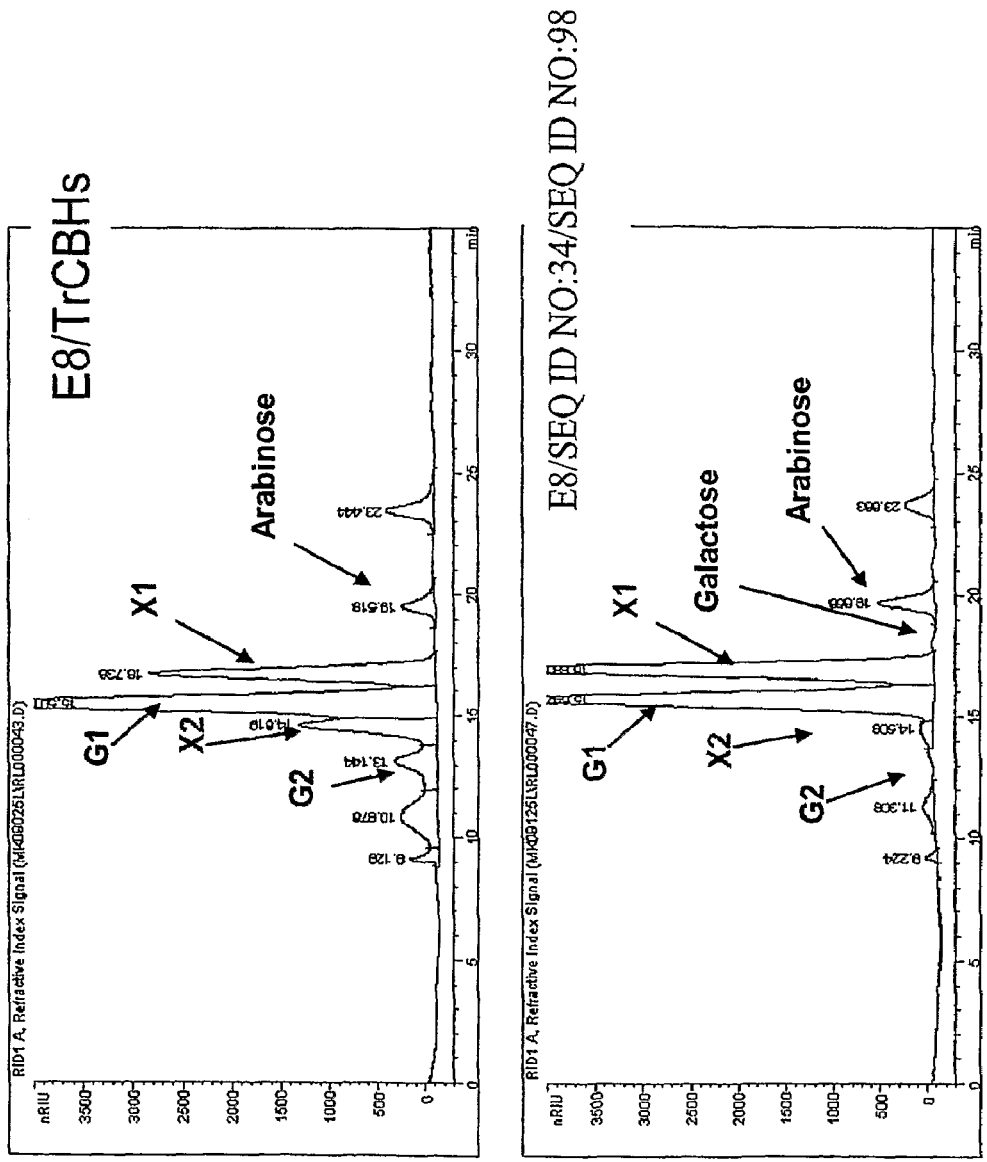
FIG. 107 illustrates the product profile from a 48 hr saccharification of Jaygo2 by an exemplary enzyme mix of the invention "E8" comprising *T. reesei* CBH I and II and two enzymes of the invention; as discussed in detail in Example 12, below.

FIG. 107 compares the product profiles of the exemplary enzyme mix of the invention "E8" comprising *T. reesei* CBH I and II to the exemplary enzyme mix of the invention "E8" comprising the SEQ ID NO:34 (encoded, e.g., by SEQ ID NO:33) and SEQ ID NO:98 (encoded, e.g., by SEQ ID NO:97) enzymes of the invention. The major differences were seen in the oligomer region and in the amount of xylose and arabinose monomers produced. FIG. 107 illustrates the product profile from a 48 hr saccharification of Jaygo2 by the exemplary enzyme mix of the invention "E8" comprising *T. reesei* CBH I and II and SEQ ID NO:34 (encoded, e.g., by SEQ ID NO:33) and SEQ ID NO:98 (encoded, e.g., by SEQ ID NO:97).

Figure 108:
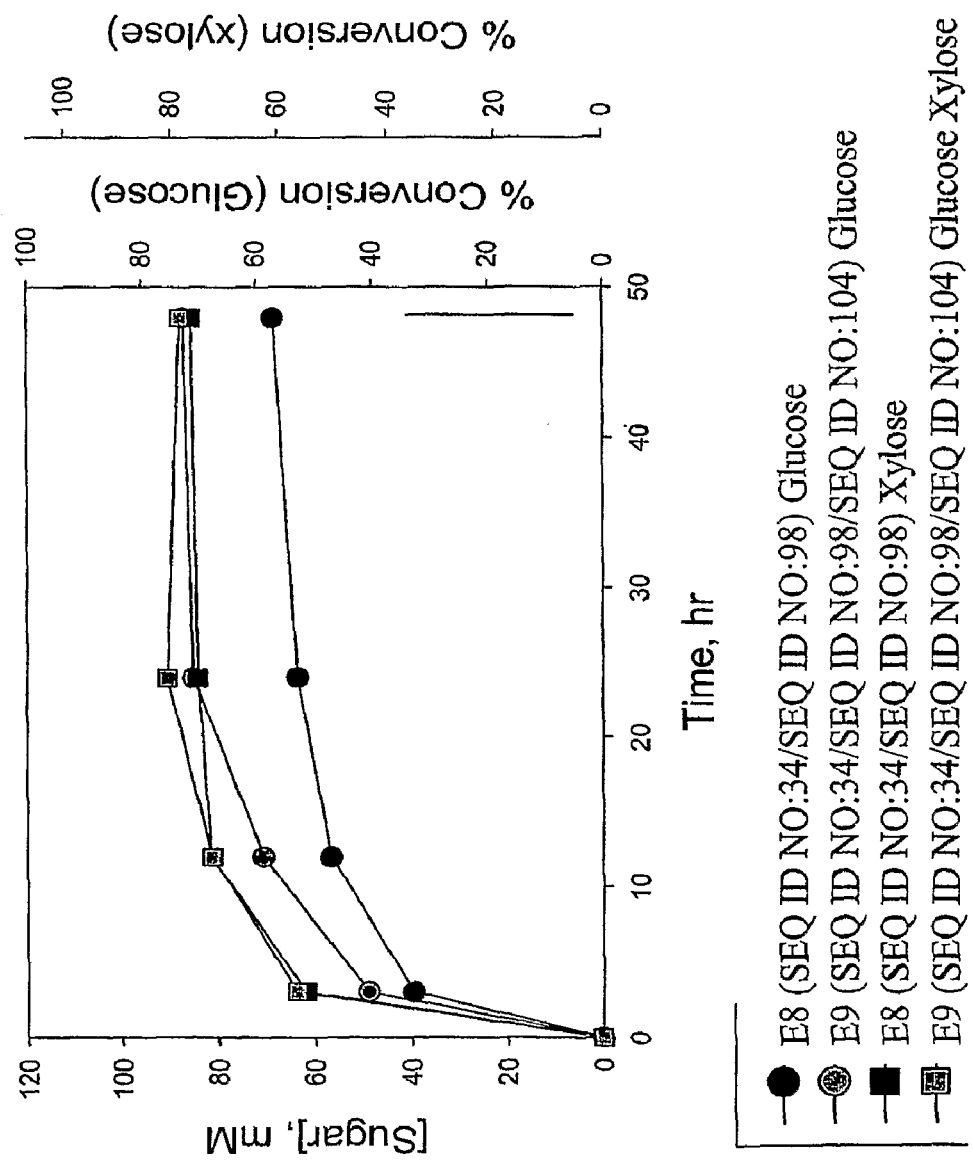
FIG. 108 graphically illustrates enzyme progress curves comparing exemplary enzyme "E8" cocktails (SEQ ID NO:34 (encoded by, e.g., SEQ ID NO:33)/SEQ ID NO:98 (encoded by, e.g., SEQ ID NO:97)) with or without SEQ ID NO:104 (encoded by, e.g., SEQ ID NO:103); as discussed in detail in Example 12, below.

The combination of the exemplary SEQ ID NO:34 (encoded, e.g., by SEQ ID NO:33), SEQ ID NO:98 (encoded, e.g., by SEQ ID NO:97) and the family 62 ARF SEQ ID NO:104 (encoded, e.g., by SEQ ID NO:103) in the E8 cocktail resulted in almost 80% xylose as monomer and 72% glucose as monomer in 24 hrs, as illustrated in FIG. 108. FIG. 108 graphically illustrates enzyme progress curves comparing E8 cocktails (SEQ ID NO:34 (encoded, e.g., by SEQ ID NO:33)/SEQ ID NO:98 (encoded, e.g., by SEQ ID NO:97)) with or without SEQ ID NO:104 (encoded, e.g., by SEQ ID NO:103). Reaction conditions: 5% solids (Jaygo 2), pH 5.5, 50° C., 18.9 mg enzyme/g cellulose.

Endoglucanase (EG) Optimization

The chimeric enzyme of the invention EG1_CDCBM3 (comprising the EG SEQ ID NO:106 (encoded, e.g., by SEQ ID NO:105) and a CBM) was more active on AVICEL™ microcrystalline cellulose than SEQ ID NO:106 (encoded, e.g., by SEQ ID NO:105).

Figure 109:
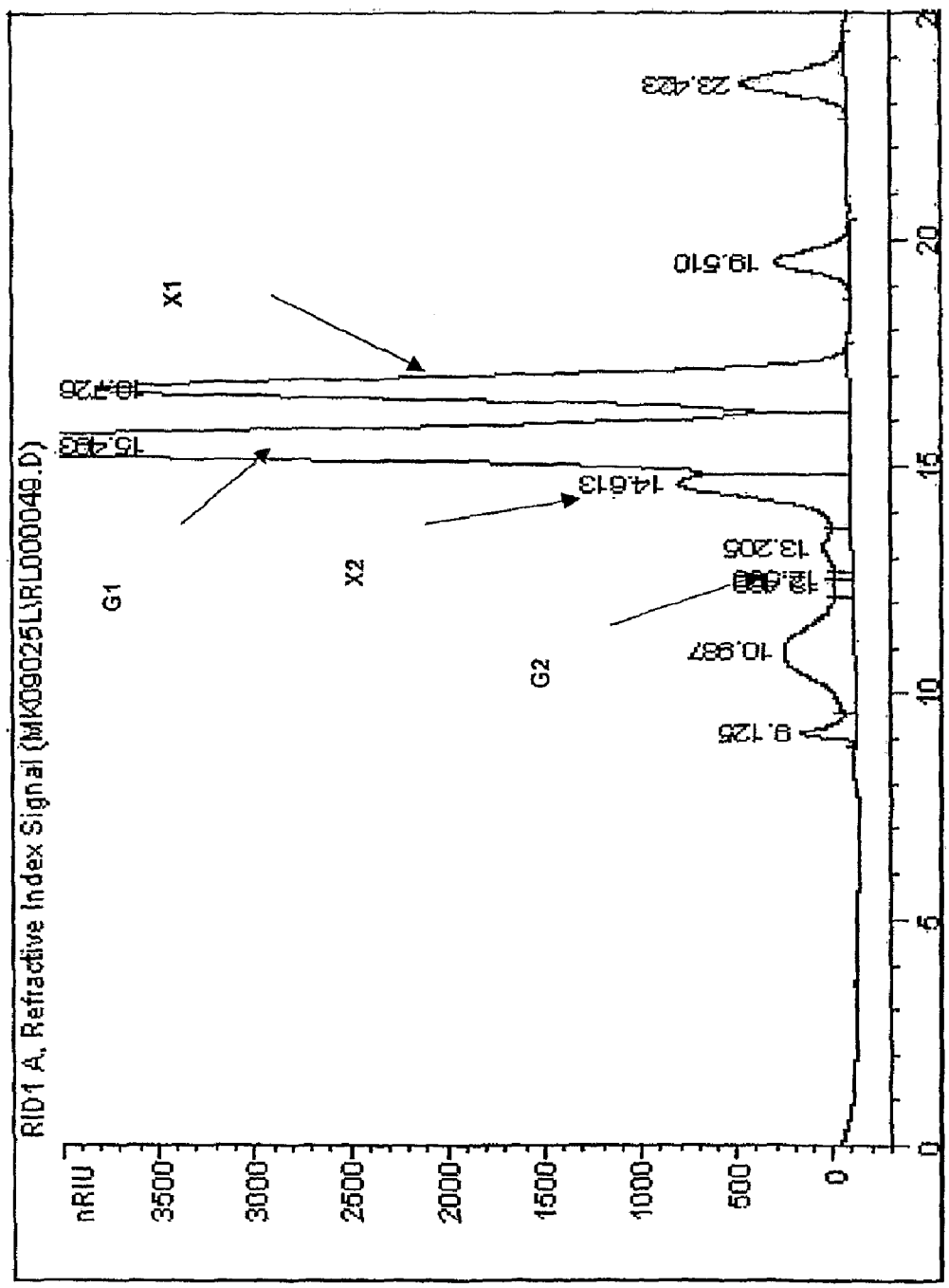
FIG. 109 graphically illustrates the product profile of the exemplary enzyme cocktail "E8", containing CBH I, CBHII and EG1_CDCBM3 (SEQ ID NO:106 (encoded by, e.g., SEQ ID NO:105) plus a carbohydrate binding domain); as discussed in detail in Example 12, below.

The product profile of the exemplary cocktail "E8" (CBH I, CBHII) cocktail containing EG1_CDCBM3 instead of SEQ ID NO:106 (encoded, e.g., by SEQ ID NO:105) showed less dimeric sugars (cellobiose/xylobiose) and more monomers (glucose/xylose) than the exemplary "E8" cocktail with SEQ ID NO:106 (encoded, e.g., by SEQ ID NO:105), as illustrated by the HPLC data plot of FIG. 109. However there was essentially no difference in the amount of total glucose (G1+G2) between the two. Depending on the desired hydrolysis result, in some aspects, this allows the opportunity to reduce the amount of the β-glucosidase (bG, or βG) SEQ ID NO:94 (encoded, e.g., by SEQ ID NO:93) in the cocktail.

CBH and β-Glucosidase Optimization

GSSM evolved mutants of the exemplary CBH enzyme SEQ ID NO:34 (encoded, e.g., by SEQ ID NO:33) were sequenced, confirming that the process produced appropriate coverage at each of four sites (within the mutagenized SEQ ID NO:34 (encoded, e.g., by SEQ ID NO:33)):

|  | # Sent to Sequencing | # Analyzed | # Amino Acids | # of Codons |
| --- | --- | --- | --- | --- |
| Site #1 | 96 | 61 | 17 | 21 |
| Site #2 | 96 | 71 | 16 | 23 |
| Site #3 | 96 | 70 | 15 | 17 |
| Site #4 | 120 | 81 | 17 | 23 |

A microtiter plate-based high throughput assay can be used to assay enzymes of the invention, and their variants and mixtures ("cocktails"), using, e.g., PASC (crystalline cellulose that is made more amorphous through swelling by acid treatment) and/or pretreated biomass (xylanase predigested, designated "HT3") as a substrate.

Overexpression of Candidate Genes

Chemical mutagenesis of *Cochliobolus* resulted in a large number of new strains that have improved secreted xylanase and b-glucosidase (with 4-methylumbelliferyl cellobioside as substrate) activities. This table summarizes the results of multiple rounds of mutagenesis and screening:

| Set | Plates | Primary Assay | Primary Hits | Secondary Hits |
| --- | --- | --- | --- | --- |
| Mut. Trial | 16 | Xylanase + 4Mu-Cell | 62 | 14 |
| 1 | 23 | Xylanase | 54 | 4 |
| 2 | 48 | Xylanase | 89 | 22 |
| 3 | 50 | Xylanase | 41 | 12 |
| 4 | 50 | Xylanase + 4Mu-Cell | 22 | 10 |
| 5 | 48 | Xylanase + 4Mu-Cell | 131 | 26 |
| 6 | 47 | Xylanase + 4Mu-Cell | 66 | 21 |
| 7 | 50 | Xylanase + 4Mu-Cell | 135 | — |
| 8* | 48 | Xylanase + 4Mu-Cell | — | — |

In summary, the exemplary CBH preparation comprising the SEQ ID NO:34 (encoded, e.g., by SEQ ID NO:33) enzyme of the invention contains an activity that converts the recalcitrant oligosaccharides into xylose and arabinose. The glycosyl hydrolase family 62 arabinofuranosidase improves the yield of glucose when added to the "E8" cocktail. A new cocktail containing SEQ ID NO:34 (encoded, e.g., by SEQ ID NO:33), SEQ ID NO:98 (encoded, e.g., by SEQ ID NO:97) and SEQ ID NO:104 (encoded, e.g., by SEQ ID NO:103) resulted in approx. 80% xylose monomer and 72% glucose monomer at a loading of 18.9 mg/g cellulose (5% solids, Jaygo 2). Addition of a family 3 CBM to EG SEQ ID NO:106 (encoded, e.g., by SEQ ID NO:105) (designated EG1_CDCBM3) improved the performance on AVICEL® microcrystalline cellulose and in the cocktail on Jaygo 2. GSSM was used to "evolve" SEQ ID NO:34 (encoded, e.g., by SEQ TD NO:33), and the activity of these mutants was validated in the fungal expression host *Cochliobolus*. Chemical mutagenesis on *Cochliobolus* was effected with the goal of improving levels of secreted protein.

Hemicellulases

Figure 110:
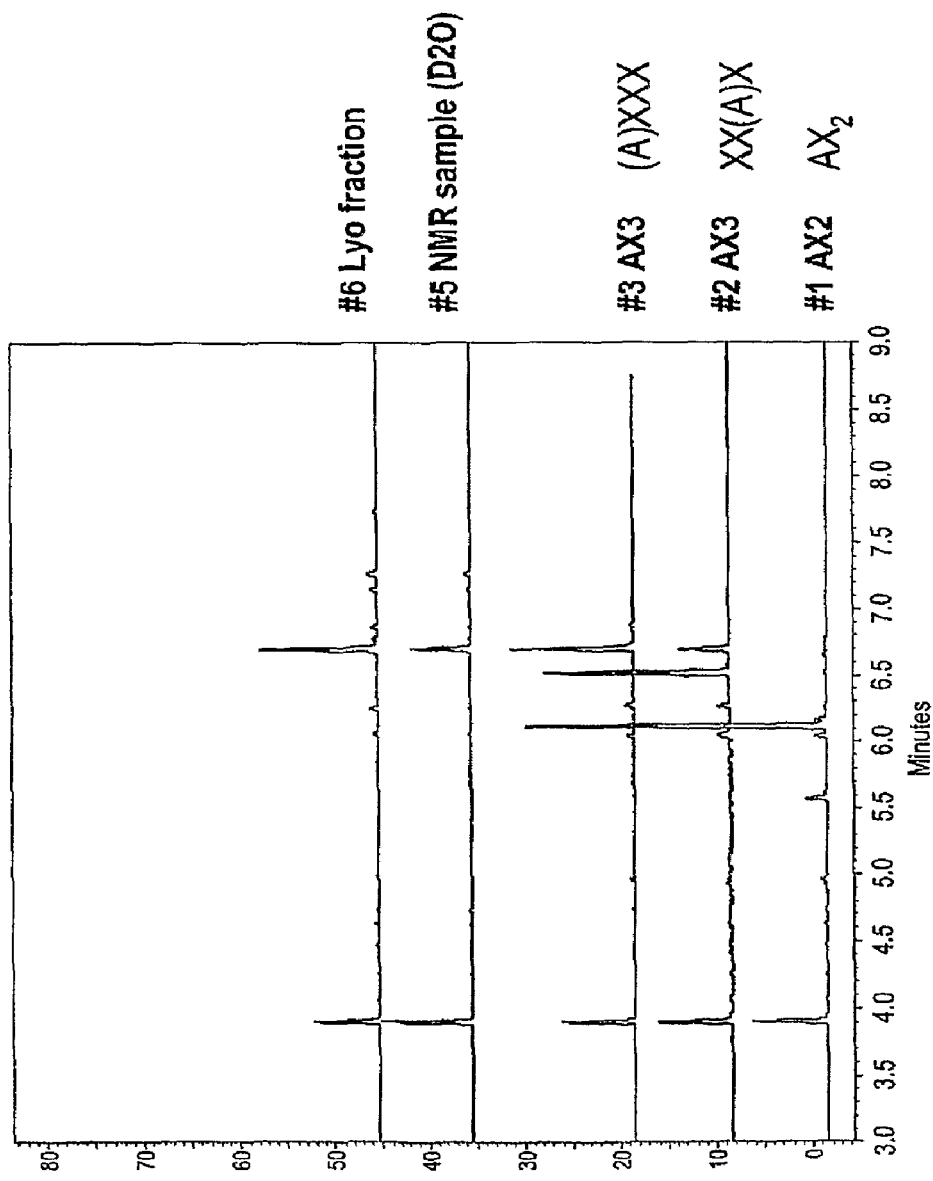
FIG. 110 illustrates the results of a capillary electrophoresis of APTS labeled arabinoxylan fragments, where #1, 2, and 3 are standard molecules while #5 and 6 are molecules isolated from saccharified liquors.
Figure 111:
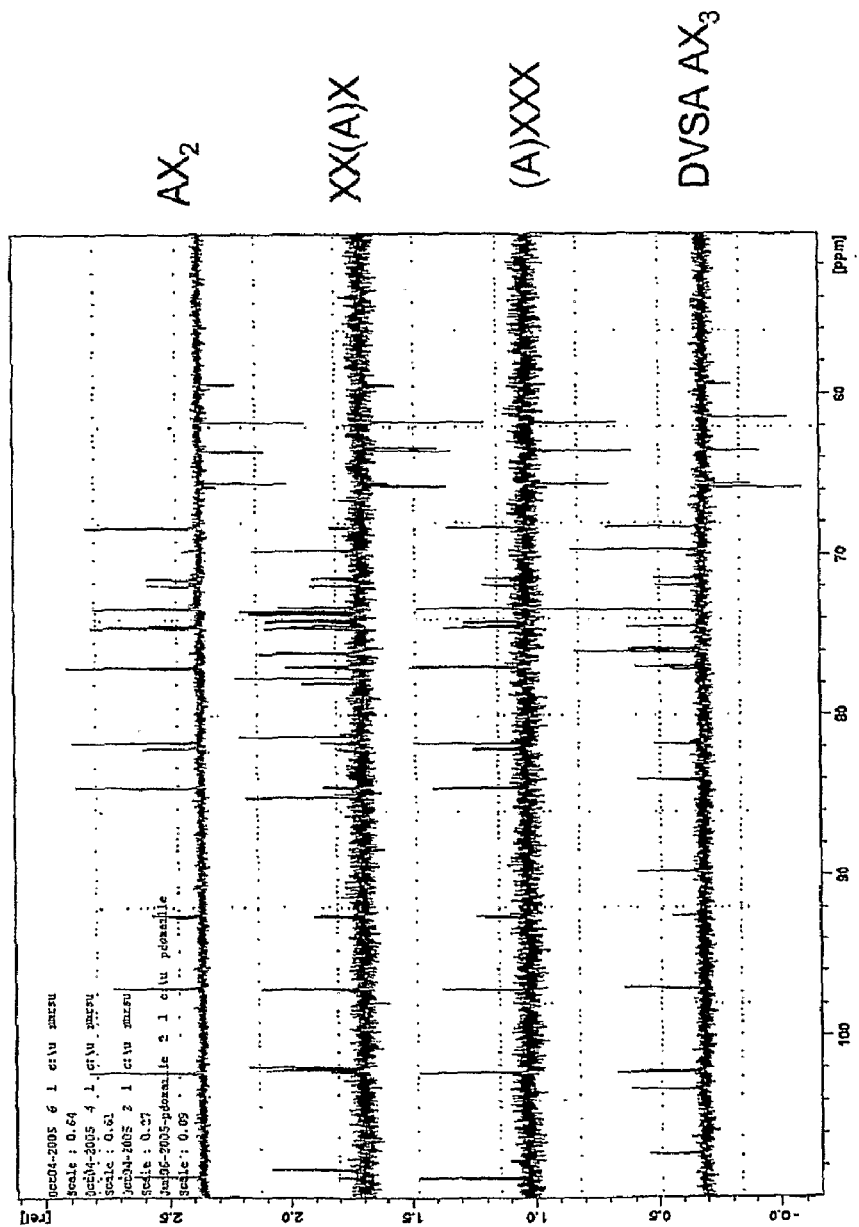
FIG. 111 illustrates the results of a $^{13}$C NMR spectra of arabinoxylan fragments; as discussed in detail in Example 12, below.

Three arabinoxylan oligomers were obtained to act as standards for the major soluble recalcitrant compound. These were AX2 and two forms of AX3, one with the arabinose linked to the central xylose and the other with the arabinose linked to the non-reducing xylose (all α-1,3). Capillary electrophoresis and $^{13}$C NMR analysis was performed on these samples and compared to our isolated compound, as illustrated in FIGS. 110 and 111. The major compound isolated from saccharified liquors has an electromigration time equivalent to AX3 with the arabinose attached to the non-reducing end of the xylan backbone; however, the NMR spectra of the 2 molecules are different. This pattern may explain why a GH51 ARF appears to be inactive on our compound. FIG. 110 illustrates the results of a capillary electrophoresis of APTS labeled arabinoxylan fragments, where #1, 2, and 3 are standard molecules while #5 and 6 are molecules isolated from saccharified liquors. The signal at about 4 minutes is free APTS. FIG. 111 illustrates the results of a $^{13}$C NMR spectra of arabinoxylan fragments.

CBH and β-Glucosidase Optimization 488 out of 491 residues of SEQ ID NO:34 (encoded by, e.g., SEQ ID NO:33) were mutagenized using GSSM technology (described above). Close to half were transformed into *E. coli*, and come transformed into *Cochliobolus*. Alternative assay substrates are AVICEL microcrystalline cellulose, PASC or xylanase predigested HT3 (xHT3). Normalization to active enzyme in the culture broth is important in assay development. An ELISA based technique can also be used.

Overexpression of Candidate Genes 74 chemically mutagenized mutants of *Cochliobolus* were grown in medium containing 1% Jaygo for 4 days and supernatant was collected for xylanase and beta-glucosidase (with 4-methylumbelliferyl cellobioside as substrate) activities. Dry cell weight of each mutant was determined at day 4.

Figure 112:
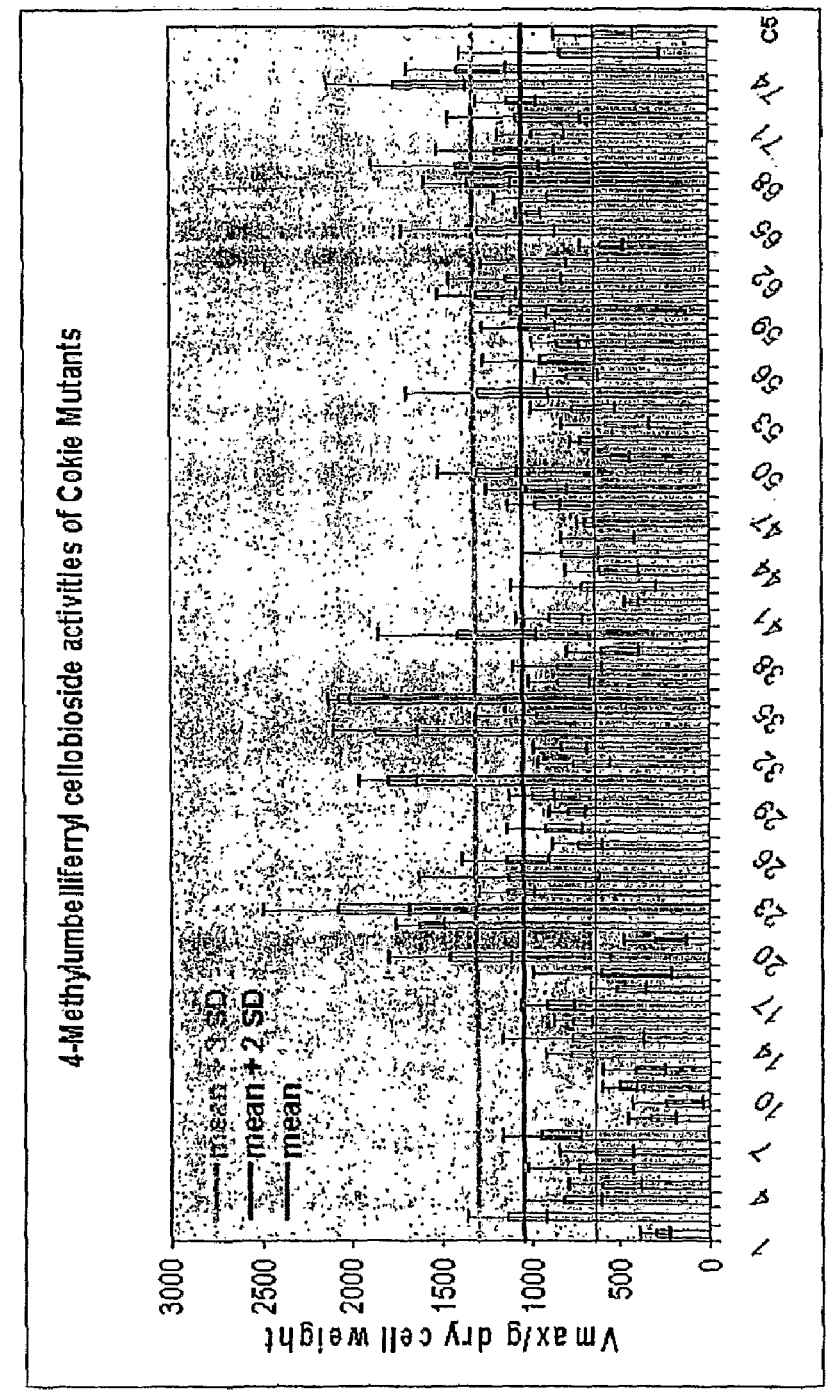
FIG. 112 illustrates secreted protein (enzyme) activity against the substrate 4-MU-cellobioside of 74 mutagenized *Cochliobolus* strains; as discussed in detail in Example 12, below.
Figure 113:
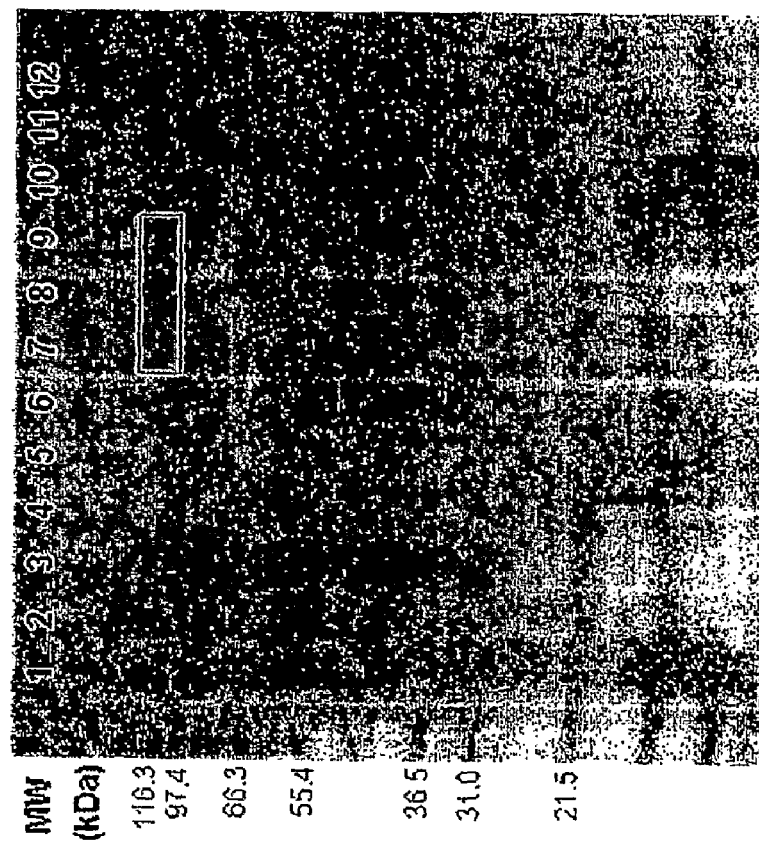
FIG. 113 illustrates secreted protein activity of mutagenized *Cochliobolus* strains using the substrate 4-MU-cellobioside; as discussed in detail in Example 12, below.

11 *Cochliobolus* mutants had higher beta-glucosidase activity than the wild type *Cochliobolus* by mean+3 standard deviation (SD) and more than 26 mutants had the activity higher than the wild type by mean+2SD, see FIG. 112. FIG. 113 illustrates secreted protein activity (against 4-MU-cellobioside) of 74 mutagenized *Cochliobolus* strains. The strains were grown for 4 days in 24 well plates using 1% Jaygo 2. Activity was normalized to dry cell weight in each well. Wild type is labeled "C5". *Aspergillus* cloning vectors can also be used.

In summary, standard arabinoxylans were used to get a better understanding of the nature of recalcitrant oligosaccharides resulting from enzymatic digestion of pretreated cob samples. Capillary electrophoreses and $^{13}$C-NMR showed that the recalcitrant material is different than known standards. GSSM technology was used to "evolve" the exemplary enzyme of the invention SEQ ID NO:34 (encoded by, e.g., SEQ ID NO:33) (a CBH). Assay development focus is on the choice of substrate and method of detection. A number of chemically mutagenized strains of *Cochliobolus* secrete more protein than the wild type strain.

Hemicellulases

As noted above, it was found that a contaminating enzyme activity within the SEQ ID NO:34 (encoded by, e.g., SEQ ID NO:33) preparation can convert a recalcitrant soluble oligosaccharides present in the standard saccharification liquors to monomeric sugars. This activity was purified from the crude SEQ ID NO:34 (encoded by, e.g., SEQ ID NO:33) sample (discussed above) using a combination of deglycosylation and chromatography. The protein was identified by SDS-PAGE and proteomics analysis, as illustrated in FIG. 113. Based on to the proteomics analysis it was concluded that the protein responsible for the hydrolysis was a native *Cochliobolus* GH family 3 enzyme. The gene is currently being subcloned and will be expressed in *Pichia* and *Aspergillus*. FIG. 113 is an illustration of an SDS-PAGE showing the purification of the enzyme activity responsible for the hydrolysis of recalcitrant oligosaccharides. Lane (1): starting material, (2) active fraction after FPLC, (3) EndoH treated sample 2, (4-12) protein fractions following a second FPLC, (7-9) the most active fractions. The box shows the most common protein band in lanes 7-9, this band was excised from the gel and sequenced.

CBH and β-Glucosidase Optimization

As noted above, the exemplary enzyme SEQ ID NO:34 (encoded by, e.g., SEQ ID NO:33) was "evolved" using GSSM technology, and a library of mutants was cloned into *E. coli*. 100 out of 491 mutants (altered sites) have been transformed into *Cochliobolus*.

Figure 114:
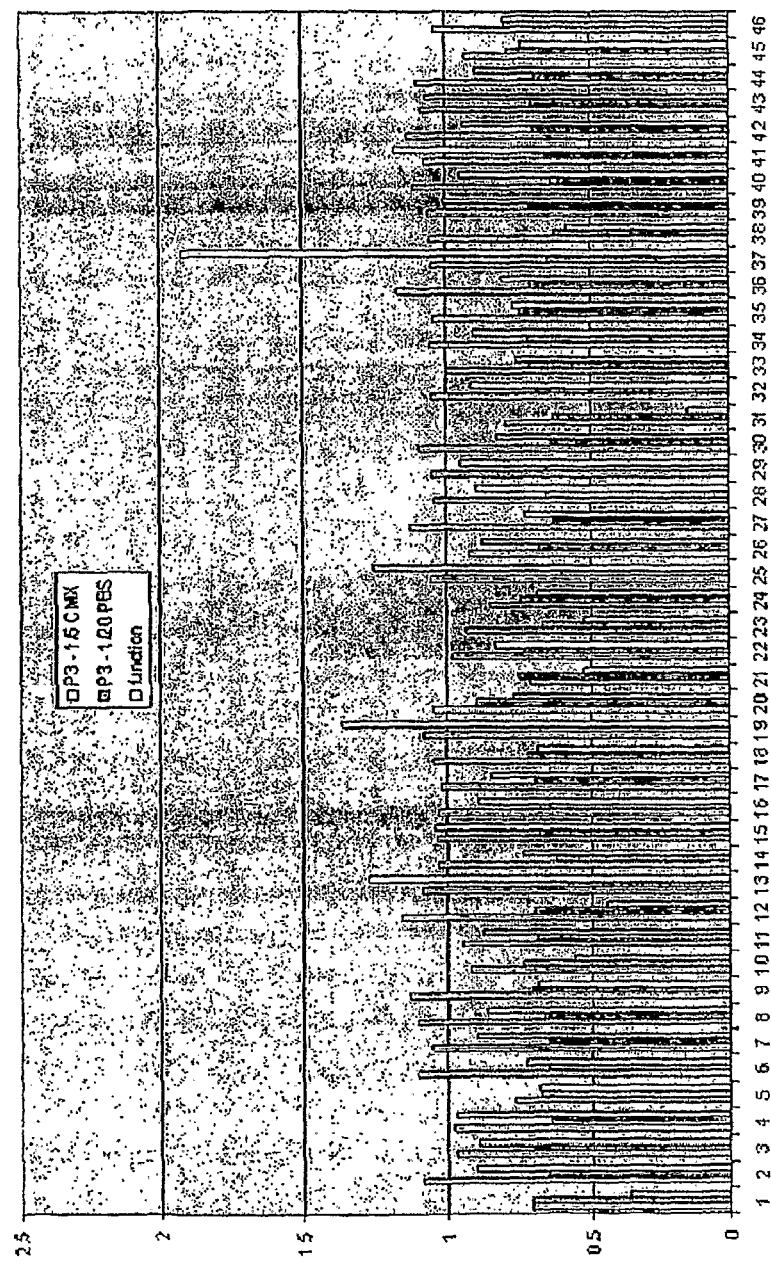
FIG. 114 illustrates functional and quantitative data from SEQ ID NO:34 (encoded by, e.g., SEQ ID NO:33) mutant expression and activity studies, wherein the enzymes are expressed in *Cochliobohis*; as discussed in detail in Example 12, below.

Enzyme amounts can be determined in each well of a 96-well plate. After activity measurements, the values can be normalized to protein content to correct for expression and growth variations in the plate. ELISA based analysis of enzyme activity can be used, and optimized. An example of SEQ ID NO:34 (encoded by, e.g., SEQ ID NO:33) grown in a 96-well plate and enzyme activity assayed on the substrate PASC is shown in FIG. 114. The corresponding ELISA data is also plotted on the same figure. FIG. 114 illustrates functional (yellow, or right bar) and quantitation (blue, or left is ⅕ CMX; and, red, or middle bar, is 1/20 PBS) data from a 96 well plate of wild type SEQ ID NO:34 (encoded by, e.g., SEQ ID NO:33) expressed in *Cochliobolus*. The functional assay was on PASC and the quantitation was done using a specific polyclonal antibody towards SEQ ID NO:34 (encoded by, e.g., SEQ ID NO:33). The conclusion is that the quantitation and function data are not yet correlating.

Figure 115:
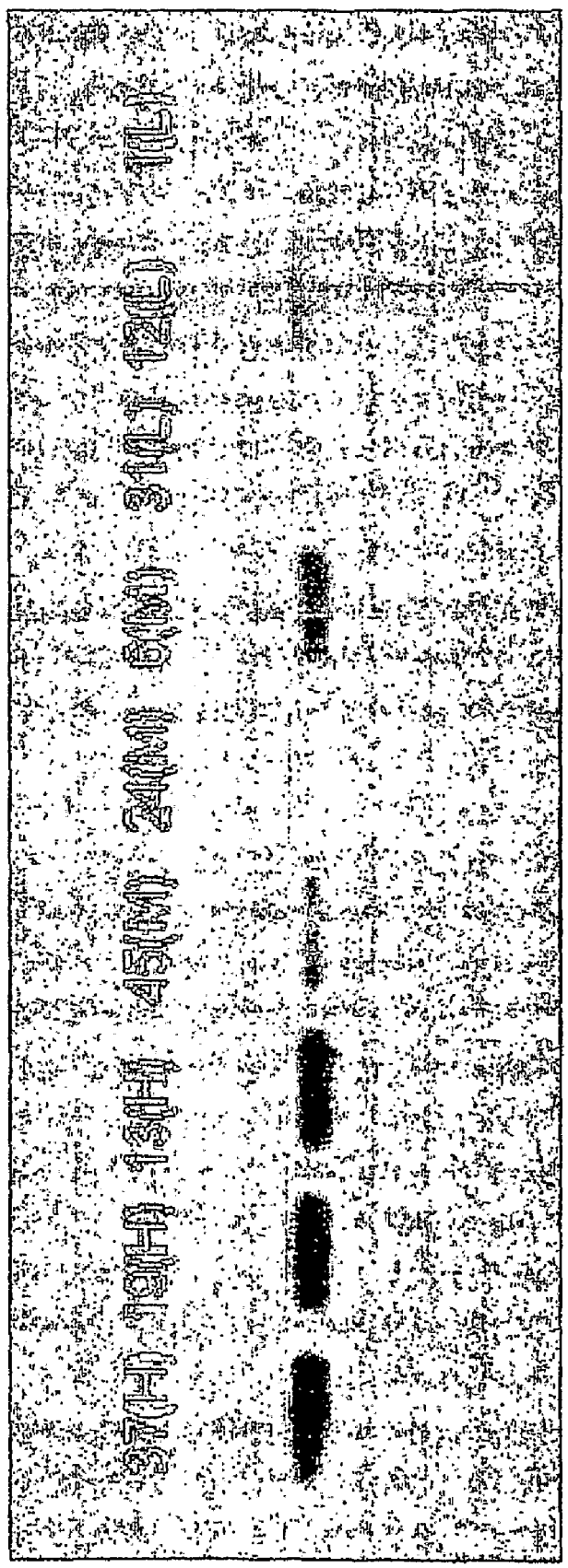
FIG. 115 is an illustration of Western blots of specific wells from FIG. 114, where SEQ ID NO:34 (encoded by, e.g., SEQ ID NO:33) was grown in a microtiter well plate and enzyme activity assayed on the substrate PASC; as discussed in detail in Example 12, below.

Though the ELISA assay did not appear to correlate with enzyme activity Western blots were more consistent (i.e., did correlate with enzyme activity), as illustrated in FIG. 115. FIG. 115 is an illustration of Western blots of specific wells from FIG. 114, as discussed above (where SEQ ID NO:34 (encoded by, e.g., SEQ ID NO:33) was grown in a microtiter well plate and enzyme activity assayed on the substrate PASC). The lanes are labeled with position as well as H (high), M (medium) and L (low) for activity in the well.

Figure 116:
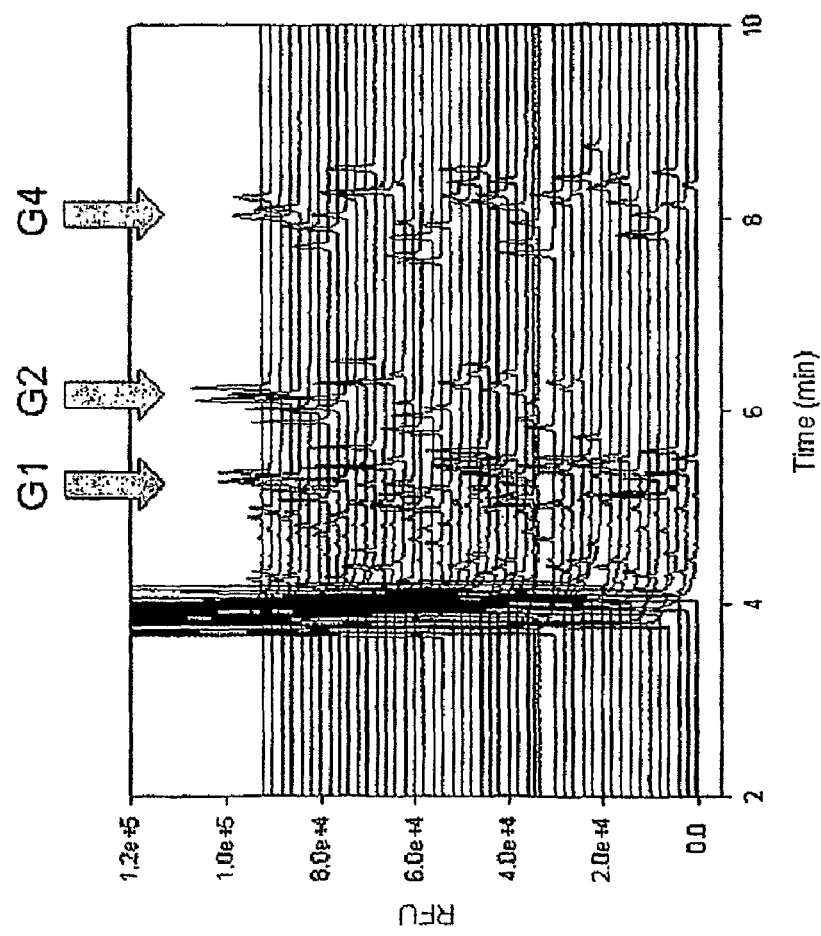
FIG. 116 is an illustration of unaligned electrophoretograms from 48 channels from a 96 channel MegaBACE™ instrument; as discussed in detail in Example 12, below.

Multi-channel capillary electrophoresis can be used to screen the GSSM library. CE has several advantages over the reducing sugar and glucose oxidase coupled reactions. The one potential disadvantage is throughput, however the MEGABACE™ (Global Medical Instrumentation, Inc. Ramsey, Minn.) instrument has 96 different capillaries in parallel and can be set up to perform medium throughput runs. Shown in FIG. 116 is an example of standards of glucose, cellobiose and maltotetraose in 48 of the channels. Since there is capillary to capillary variation the data must be further processed to align the standards and generate standard curves, however it is apparent that this method can be useful for screening a GSSM library. FIG. 116 is an illustration of unaligned electrophoretograms from 48 channels from a 96 channel MegaBACE™ instrument. Various concentrations of glucose (G1), cellobiose (G2) and maltotriose (G4) were labeled with APTS and separated on the MegaBACE™.

A GSSM library also was constructed of the β-glucosidase SEQ ID NO:94 (ENCODED BY SEQ ID NO:93); i.e., the exemplary enzyme SEQ ID NO:94 (ENCODED BY SEQ ID NO:93) was "evolved" using GSSM technology, and a library of expression vectors comprising the various mutations was made.

Overexpression of Genes

Figure 117:
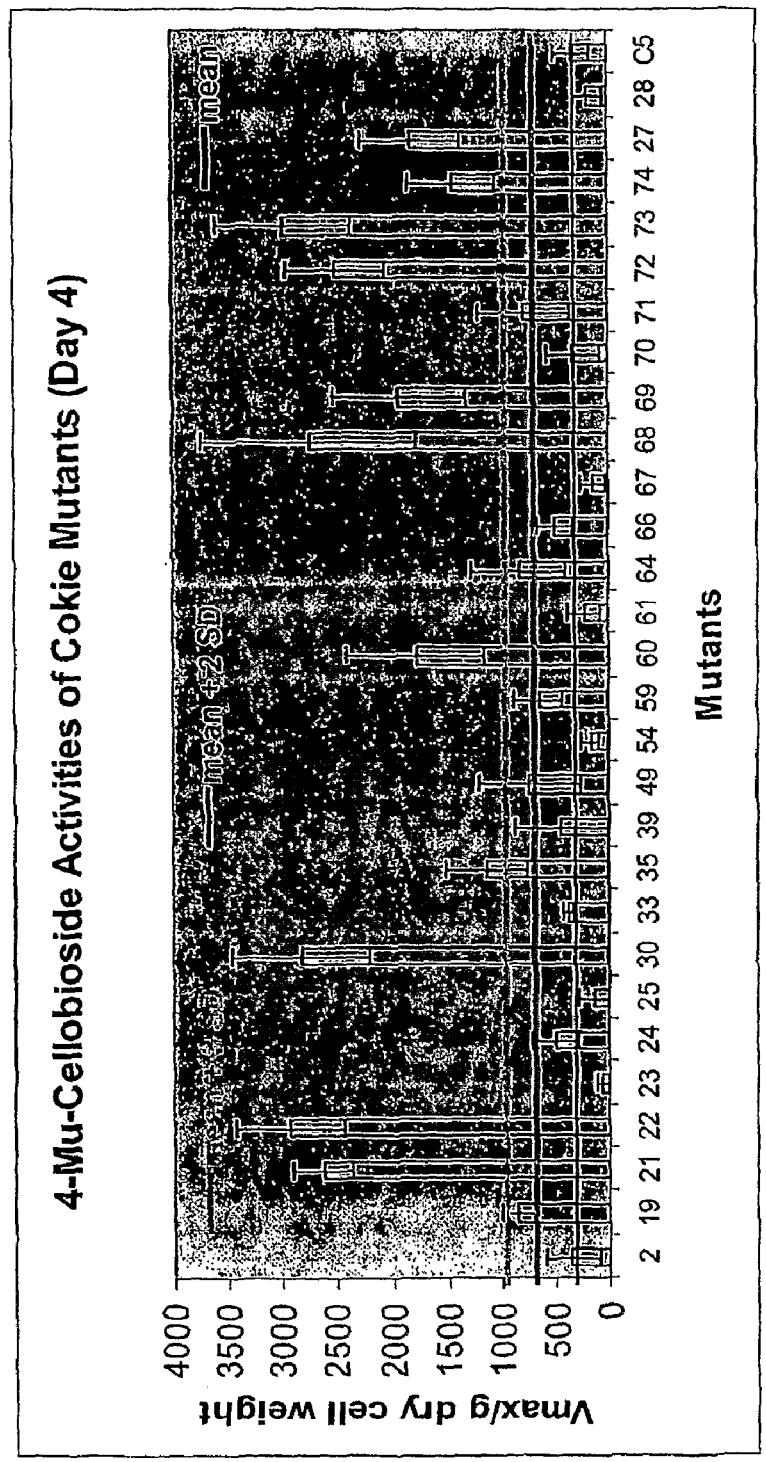
FIG. 117 shows data reconfirming the high protein expression and activity of various "over-expressing" *Cochliobolus* strains; as discussed in detail in Example 12, below.

*Cochliobolus* were chemically mutagenized, screened for expression, and mutated strains with increased protein production were identified. As noted above, two secreted enzymes—xylanase and general cellulase were studied in this system. These data indicated that 11 of the original 74 strains appeared to secrete more β-glucosidase activity than the wild type strain (mean activity >3SD from the wild type). These experiments were repeated and the same results seen, as illustrated in FIG. 117. FIG. 117 shows data reconfirming the high protein expression of top candidate "over-expressing" Cochliobolus strains. Strains were grown in 1% Jaygo 2 for 4 days and culture broths assayed for hydrolysis of 4-MUB-cellobioside. Activity was corrected for dry cell weight in the culture. The lane designated "C5" is the wild type control.

Figure 118:
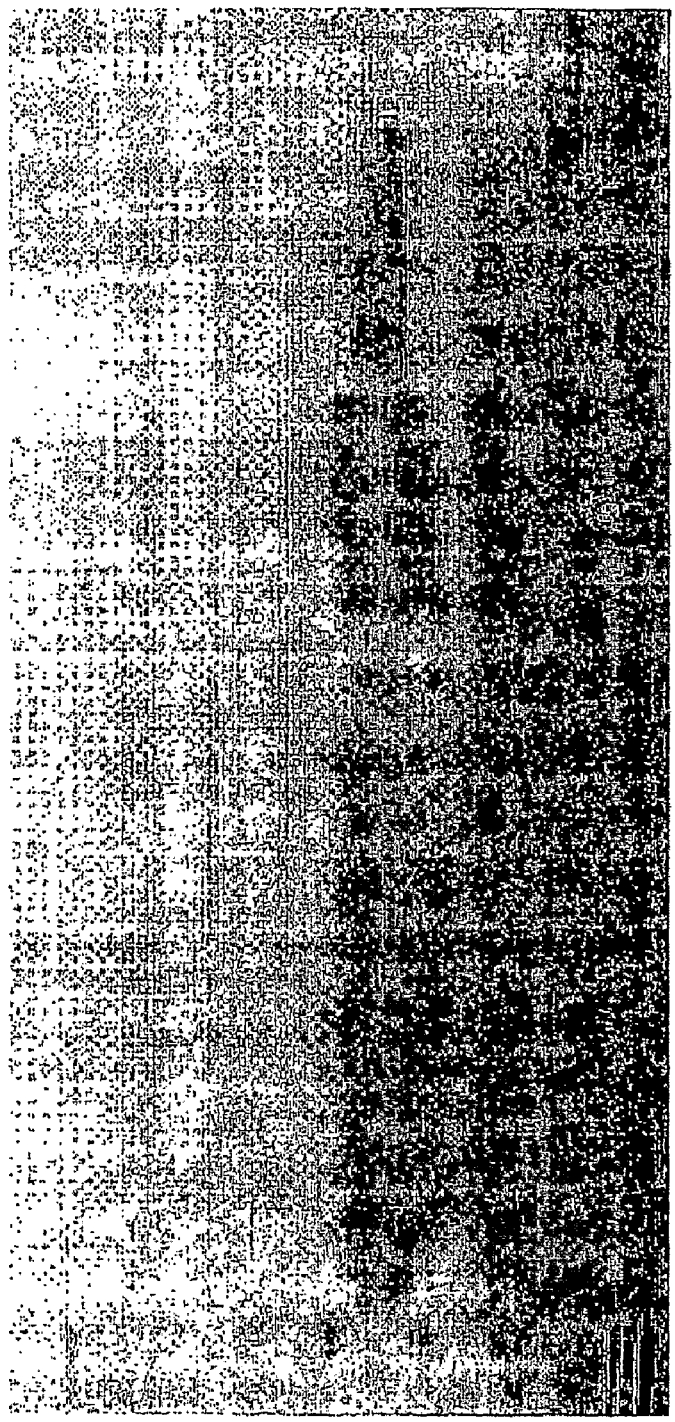
FIG. 118 is an illustration of an SDS-PAGE of secreted proteins of various "over-expressing" *Cochliobolus* strains; as discussed in detail in Example 12, below.

In addition SDS-PAGE gels were run on the secreted protein, as illustrated in FIG. 118. The SDS-PAGE results suggest that there is an overall increase in total protein secreted from each strain. FIG. 118 is an illustration of an SDS-PAGE of the secreted protein of the top 10 "over-expressing" Cochliobolus strains. 15 ul of culture broth was loaded into each lane. The numbers along the bottom are the strain designation (see FIG. 117 for the corresponding activity measurement). The lane designated "C5" is the wild type control.

Figure 119:
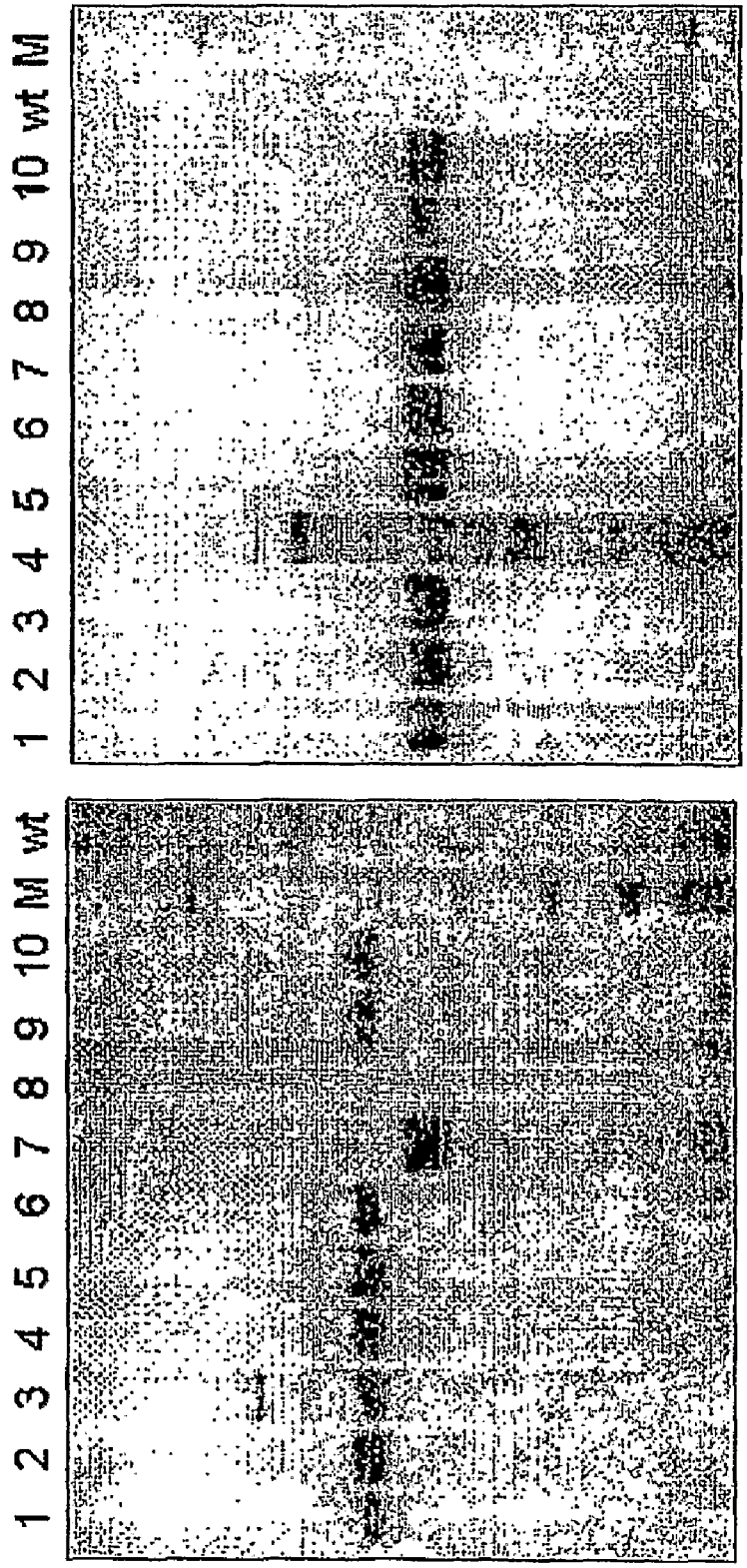
FIG. 119 illustrates an SDS-PAGE of secreted proteins of 10 individual transformants of exemplary enzymes SEQ ID NO:98 (encoded by, e.g., SEQ ID NO:97) and SEQ ID NO:34 (encoded by, e.g., SEQ ID NO:33) in *Aspergillus*; as discussed in detail in Example 12, below.

In one aspect, enzymes of the invention are expressed in these "over-expressing" Cochliobolus strains; e.g., in strains engineered to express the exemplary enzymes of the invention CBHs SEQ ID NO:34 (ENCODED BY SEQ ID NO:33) and SEQ ID NO:98 (ENCODED BY SEQ ID NO:97). In another aspect, enzymes of the invention are expressed in an Aspergillus model—10 CBH genes were cloned and transformed into Aspergillus. Expression was tested in 8 of the new strains and 7 show very clear protein bands on SDS-PAGE. Examples of ten different transformants of the exemplary enzymes SEQ ID NO:98 (ENCODED BY SEQ ID NO:97) and SEQ ID NO:34 (ENCODED BY SEQ ID NO:33) are shown in FIG. 119. FIG. 119 illustrates an SDS-PAGE of the secreted proteins of 10 individual transformants of SEQ ID NO:98 (ENCODED BY SEQ ID NO:97) and SEQ ID NO:34 (ENCODED BY SEQ ID NO:33) in Aspergillus. Untransformed host is shown in the lane labeled "wt".

Figure 120:
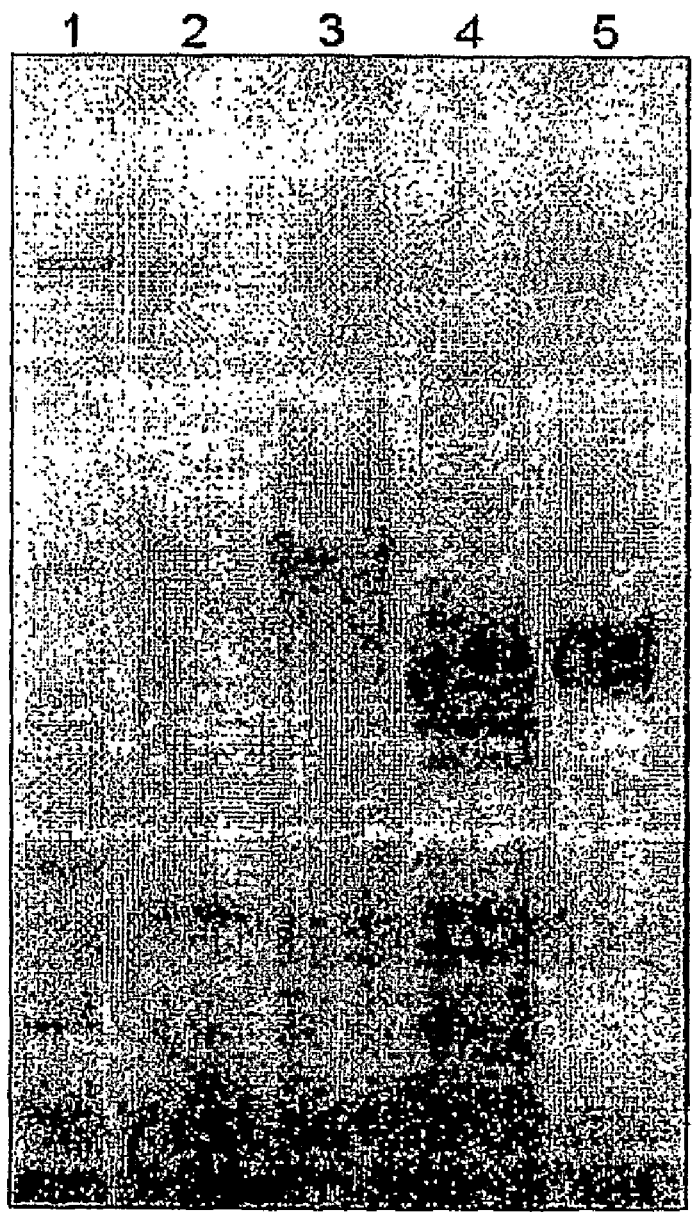
FIG. 120 illustrates an SDS-PAGE of *Aspergillus*- and *Cochliobolus*-produced exemplary enzymes of the invention, SEQ ID NO:34 (encoded, e.g., by SEQ ID NO:33) and SEQ ID NO:98 (encoded, e.g., by SEQ ID NO:97), to compare their production in the two exemplary cell expression systems; as discussed in detail in Example 12, below.

A comparison between the production of SEQ ID NO:98 (ENCODED BY SEQ ID NO:97) and SEQ ID NO:34 (ENCODED BY SEQ ID NO:33) in Cochliobolus and Aspergillus is shown in FIG. 120. Clearly the Aspergillus system is producing more protein. In addition the molecular weights for the produced protein from each sample look similar. FIG. 120 illustrates an SDS-PAGE of Aspergillus- and Cochliobolus-produced SEQ ID NO:34 (ENCODED BY SEQ ID NO:33) and SEQ ID NO:98 (ENCODED BY SEQ ID NO:97) enzymes. Lane 1: molecular weight standards, Lane 2: SEQ ID NO:98 (ENCODED BY SEQ ID NO:97)—Cokie (15 uL), Lane 3: SEQ ID NO:98 (ENCODED BY SEQ ID NO:97)—Aspergillus (5 uL), Lane 4: SEQ ID NO: 34 (ENCODED BY SEQ ID NO:33)—Cokie (15 uL), Lane 5: SEQ ID NO:34 (ENCODED BY SEQ ID NO:33)—Aspergillus (5 uL). The activity of these, or any Aspergillus- and Cochliobolus-expressed enzymes of the invention (including testing the enzyme mixes or "cocktails" of the invention), also can be tested using the substrate PASC.

Example 13

Exemplary Enzyme Cocktails of the Invention

This example describes exemplary enzyme cocktails of the invention. In one embodiment, a "cocktail" of the invention comprises SEQ ID NO:46 (encoded, e.g., by SEQ ID NO:45) as the CBH I (or, alternatively, the CBH I can be SEQ ID NO:34, encoded, e.g., by SEQ ID NO:33) and SEQ ID NO:524 (encoded, e.g., by SEQ ID NO:523) as the xylanase (or, alternatively, the xylanase can be SEQ ID NO:100, encoded, e.g., by SEQ ID NO:99).

In alternative embodiments, loadings for CBH 1, e.g., SEQ ID NO:46 and/or SEQ ID NO:34, can either be 2.5 mg/g cellulose or 5 mg/g cellulose, or anywhere in the range of between 0.05 and 10.0 mg/g cellulose, e.g., 0.05, 0.1; 0.2; 0.3; 0.4; 0.5; 1.0; 1.5; 2; 2.1; 2.2; 2.3; 2.4; 2.5 etc. including all values to about 10.0 mg/g cellulose, or more.

In alternative embodiments, loadings for the xylanase, e.g., SEQ ID NO:524 and/or SEQ ID NO:100, can be 0.2 or 0.6 mg/g cellulose, or anywhere in the range of between 0.05 and 10.0 mg/g cellulose, e.g., 0.05, 0.1; 0.2; 0.3; 0.4; 0.5; 1.0; 1.5; 2; 2.1; 2.2; 2.3; 2.4; 2.5 etc. including all values to about 10.0 mg/g cellulose, or more. Equivalent xylose conversion numbers can be attained using either 0.2 or 0.6 mg SEQ ID NO:524 (encoded, e.g., by SEQ ID NO:523)/g cellulose. In one aspect, a major benefit of this exemplary cocktail is improved xylose conversion.

In alternative embodiments, loadings for endoglucanase, e.g., SEQ ID NO:106, can be 1.7 mg/g cellulose or anywhere in the range of between 0.05 and 10.0 mg/g cellulose, e.g., 0.05, 0.1; 0.2; 0.3; 0.4; 0.5; 1.0; 1.5; 2; 2.1; 2.2; 2.3; 2.4; 2.5 etc. including all values to about 10.0 mg/g cellulose, or more.

In alternative embodiments, loadings for oligomerase-1, e.g., SEQ ID NO:522, can be 0.5 mg/g cellulose or anywhere in the range of between 0.05 and 10.0 mg/g cellulose, e.g., 0.05, 0.1; 0.2; 0.3; 0.4; 0.5; 1.0; 1.5; 2; 2.1; 2.2; 2.3; 2.4; 2.5 etc. including all values to about 10.0 mg/g cellulose, or more.

In alternative embodiments, loadings for CBH 2, e.g., SEQ ID NO:98, can be 1.0 mg/g cellulose or anywhere in the range of between 0.05 and 10.0 mg/g cellulose, e.g., 0.05, 0.1; 0.2; 0.3; 0.4; 0.5; 1.0; 1.5; 2; 2.1; 2.2; 2.3; 2.4; 2.5 etc. including all values to about 10.0 mg/g cellulose, or more.

In alternative embodiments, loadings for arabinofuranosidase, e.g., SEQ ID NO:92, can be 0.25 mg/g cellulose or anywhere in the range of between 0.05 and 10.0 mg/g cellulose, e.g., 0.05, 0.1; 0.2; 0.3; 0.4; 0.5; 1.0; 1.5; 2; 2.1; 2.2; 2.3; 2.4; 2.5 etc. including all values to about 10.0 mg/g cellulose, or more.

In alternative embodiments, loadings for xylanase, e.g., SEQ ID NO:102, can be 0.15 mg/g cellulose or anywhere in the range of between 0.05 and 10.0 mg/g cellulose, e.g., 0.05, 0.1; 0.2; 0.3; 0.4; 0.5; 1.0; 1.5; 2; 2.1; 2.2; 2.3; 2.4; 2.5 etc. including all values to about 10.0 mg/g cellulose, or more.

In alternative embodiments, loadings for oligomerase-2, e.g., SEQ ID NO:520, can be 1.0 mg/g cellulose or anywhere in the range of between 0.05 and 10.0 mg/g cellulose, e.g., 0.05, 0.1; 0.2; 0.3; 0.4; 0.5; 1.0; 1.5; 2; 2.1; 2.2; 2.3; 2.4; 2.5 etc. including all values to about 10.0 mg/g cellulose, or more.

Exemplary cocktails of the invention include:

| E8* Cocktail | | |
|---|---|---|
| Enzyme | Family/class/type | Loading: Pure enzyme, mg/g cellulose |
| SEQ ID NO: 106 (encoded, e.g., by SEQ ID NO: 105) | Endoglucanase | 1.7 |
| SEQ ID NO: 522 (encoded, e.g., by SEQ ID NO: 521) | Oligomerase-1 (β-glucosidase) | 0.5 |
| SEQ ID NO: 46 (encoded, e.g., by SEQ ID NO: 45) | Family 7 - CBH1 | 5 2.5 |
| SEQ ID NO: 98 (encoded, e.g., by SEQ ID NO: 97) | Family 6 - CBH2 | 1 |
| SEQ ID NO: 92 (encoded, e.g., by SEQ ID NO: 91) | Arabinofuranosidase | 0.25 |

E8* Cocktail

| Enzyme | Family/class/type | Loading: Pure enzyme, mg/g cellulose |
|---|---|---|
| SEQ ID NO: 102 (encoded, e.g., by SEQ ID NO: 101) | Family 10 - xylanase | 0.15 |
| SEQ ID NO: 520 (encoded, e.g., by SEQ ID NO: 519) | Oligomerase-2 (β-xylosidase) | 1 |
| SEQ ID NO: 524 (encoded, e.g., by SEQ ID NO: 523) | Xylanase | 0.1 0.2 0.3 0.6 |
| | Total loading | Approx. 10 mg/g |

Figure 123:
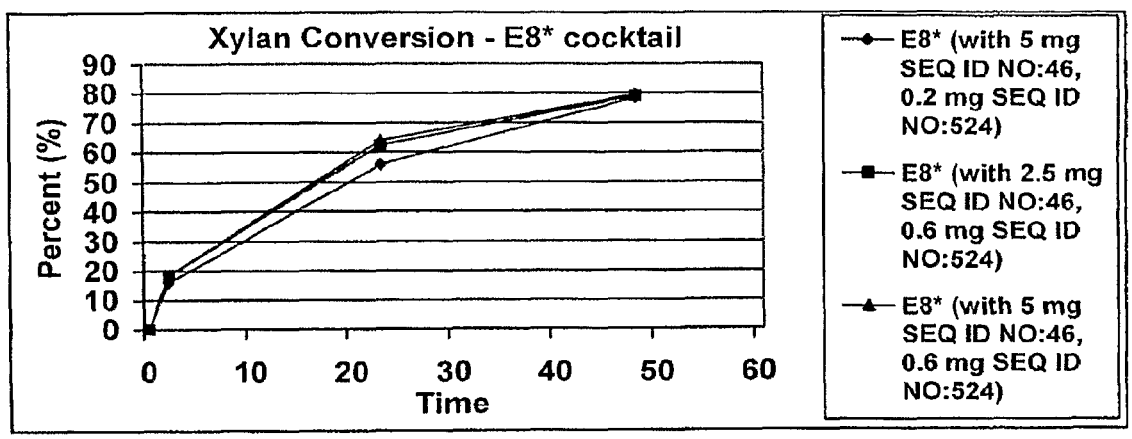
FIG. 123 graphically illustrates data showing the percent xylan conversion over time for the exemplary cocktails of the invention, as discussed in detail in Example 13, below.

FIG. 123 graphically illustrates data showing the percent xylan conversion over time for the exemplary "E*" cocktails of the invention noted immediately above comprising: 5 mg SEQ ID NO:46 and 0.2 mg SEQ ID NO:524; 2.5 mg SEQ ID NO:46 and 0.6 mg SEQ ID NO:524; 5 mg SEQ ID NO:46 and 0.6 mg SEQ ID NO:524.

A number of aspects of the invention have been described. Nevertheless, it will be understood that various modifications may be made without departing from the spirit and scope of the invention. Accordingly, other aspects are within the scope of the following claims.

SEQUENCE LISTING (524 sequences)

SEQ ID NO: 1 - DNA, 1374 bp, Unknown
  Obtained from environmental sample
atgtacaaacaactcgcccttgcttccctctccctattcgggcttgtaaacgcccagcaggtgggcactcagacgactgagaagcacccagcgctgtcctggaagacctgcactggcactggcggaaaaagctgtacctccaagacggcctcgattaccatcgatgctaactggcgatgggcccatgttacgagcggatacaccaactgctacaccgacaacacctggaactccaccagctgcaaggatggtgccacctgtgcgaagaactgtgctatcgatggcgctgactactctggcacctacggtattacgaccagctccgatgctcttaccctcaagttcgtcaccaagggctcgtactcgaccaatatcggatcccgcacctacctcatggacacagacagcaagtaccagatgttcaaccccatcggcaaggagttcacgttcgatgtcgatgtttccaagcttccttgcggtttaaatggtgctctgtacttcgtcgagatggctgctgatggtggtatgggcaagggcaacaacaaggctggtgccaagtacggaactggctactgcgatgcccaatgccctcatgacgtgaagtggatcaacggtgcggctaattcggaaggctgggagccatccagcaatgataagaatgccggaagcggcaagtacggcgcctgctgcccggagatggatatctgggaggccaactccatctctactgcctacaccccacacccctgcaagcagaacggtatctttgcctgcactggcaccgactgcggtgatggcgacaaccgatatggcggcaactgcgacaaagacggatgcgatttcaacagctaccgcatgggtgtcaaggacttctacggcccgggaatgacccttgacactaacaagaagatgaccgttgtgacccaattcatcggcagcggcacatcccttactgaaatcaagcgcttctacgtccagaatggaaaggttttcaagaactcggcctctgcaatcgacggcgtcacgggtaactccatcacggacgacttctgcgcagcgcaaaagaaggcctttggcgacacttcctccttcgctgatcgtggcggtctcaagggaatggcctcctctctcgcaaagggtcacgtcttggtcatgtcactgtgggacgaccatgcggttaatatgctctggctcgattcgacttatcccaccgataaggatgcctccactcccggtgtgggtcgtggtacttgtggaacggactcaggcaagccggaagatgttgagagcaagtcgccggatgcgcaggttatctactccaatattcgctttggtcctattggatctactttcgatgagtccgctgccgtttaa

SEQ ID NO: 2 - protein, 457 aa, Unknown
  Obtained from environmental sample
  SIGNAL (1)...(18)
  DOMAIN (20)...(453): Glycosyl hydrolase family 7
MYKQLALASLSLFGLVNAQQVGTQTTEKHPALSWKTCTGTGGKSCTSKTASITIDANWRWAHVTSGYTNCYTDNTWNSTSCKDGATCAKNCAIDGADYSGTYGITTSSDALTLKFVTKGSYSTNIGSRTYLMDTDSKYQMFNPIGKEFTFDVDVSKLPCGLNGALYFVEMAADGGMGKGNNKAGAKYGTGYCDAQCPHDVKWINGAANSEGWEPSSNDKNAGSGKYGACCPEMDIWEANSISTAYTPHPCKQNGIFACTGTDCGDGDNRYGGNCDKDGCDFNSYRMGVKDFYGPGMTLDTNKKMTVVTQFIGSGTSLTEIKRFYVQNGKVFKNSASAIDGVTGNSITDDFCAAQKKAFGDTSSFADRGGLKGMASSLAKGHVLVMSLWDDHAVNMLWLDSTYPTDKDASTPGVGRGTCGTDSGKPEDVESKSPDAQVIYSNIRFGPIGSTFDESAAV

SEQ ID NO: 3 - DNA, 2577 bp, Unknown
  Obtained from environmental sample
atgctttcgaaccgccggttgatccgtacgattccgcttggcgccgccgcgtacagcgtgctgctggggctggccggttgcagccagagcacggttgcgaccgcgccagccgtcgagcctaccgcatcgcaggccatggtcgcgcagccgcagaactggccgcgcgtggattggccgcttccgcacgatgcggcgctcgaagcgcgcgtggatgcgctgctggcgacgatgagcgtggaggagaaggtcggccagatcgtgcagggcgacatcgacagcatcacgccggaagaccttcgcaagtatcggctgggttcgatcctggccggcggcaattccgatccgggcaggaagtacaacgccgctccttcggaatggctggcgctggccgatgcgttctgggaagcctcgatggatacctctggcggcggcaaggcgatcccggtgatcttcggcatcgacgcggtgcatggacagagcaacatcgtcggagccacgctgtttccgcacaacatcggtttgggcgcaacgcgcaatcccgatctcatccgggaaattggccgcatcaccgcggtggaaacccgcgttacaggcatggaatggacgttcgcgccaacggtcgcggttccgcaggacgaccgctgggggcgcagctacgagggctattcggaaagcgccgatgtcgtcgccagctttgcgccggcgatggtcgaaggactgcagggcatggccggtgcggcggatttcctcgacgaccatcatgtgatgacgtcgatcaagcatttcctcggggatggcggcacgcgcgacggcaaggatcagggcgacaccctcgcgagcgaagcgcagctgcgcgacatccacgccgccggctacatcaccggcatcgcagcgggcgcgcaggcagtaatggcctcgtacaacagctggcatggcgaaaagatgcacgggcgccgcgacctgctcaccgatgtgctgaaggggcgcatggatttcggcggcttcgtggtcggcgattggaatggccacggtcaggtggcgggctgtaccaataccgattgtccggcttcattcaacgccggcctggacatggcgatggcgcccgacagctggaagggcctgtacgagagcacgctggcgcacgtgaaggcaggcacgatcccgatgcagcggctggacgatgcggtgcgccgtatcctgcgggtcaagttccgcatggggctgttcgagaagccgcggccttcgcagcgtgcgctcggcggcaagttcgaactgctcggagcgccggagcatcgcgcggtggcacgtcaggcggtgcgtgaatccctggtgttgctgaagaaccagaacggcctgttgccgctttccccgaatcagagactgctggtggccggcgacggcgcgaacgatctgggcaagcaatccggcggttggacgctcaactggcagggcaccggcaccacgcgtgccgattacccgaacgcggattcgatctgggaagggctcaaggcgcaggtcgaagcggcgggcggtcaggccgagcttgccgtcgatggccagtaccggaaccgaccggacgcggccatcgtcgtgttcggcgagaacccgtacgcggagttccagggagacatcccgaacctgctgtaccgccccggagacgatggcgacctggaactgatccgtcgcctgaaggctgaaggcatcccggtggttgcggtgttcctgagcggcaggccgctgtggatgaatcgcgagatcaacgcggccgatgccttcgtcgcggcctggttgccgggctctgaaggtggcggcgtcgccgatgtgctgctgcgtggcgcggacggcaaggtccagcacgatttcaagggcaagctgagtttctcgtggccgcgtcgcgccgaccagttcgacaacaatgtcggtcaggaaaactacgatccgctgttcgcgttcgggtatggcctgacttatgccgacgacggcgatgtggcgccgttgtccgaggattcgggcatctccggacaggtgtcgcaggcgaatgtgttcttctcgcatggcgttgcgagccaaggcttgaggctgcgcctgatcggcgctgatggcggcatcgcggacgtgatgcatccgcaggcgaagaccgccgacggcacgctggttcttagcgcgatcgactaccagcgccaggaaggtgcacgtcgtttggtgtggacgggcagggcgaccgcggaactgctttccaccacgccgctcgacctgggccgggaaaccaacggcgacgtgaagatcgttgccacgctgcgcatcgacgcgcttccggccgatggcgacgtggcgctgatcgcgcgcagtggtgatcgcagtgccgaacttccgatcggcgactggttcgccagtcttccgcgcgggcagtggttgagcgcgggcgtgctgctcaagtgcctgcgtgtcgctggttcggatacggcgaagctggacgcgccgttctccatccgtggcagcgcagggctggaactggcgctggcgcaagtggtggcggccaccgccgacgacacgcatctggactgcccgatccagtag

SEQ ID NO: 4 - protein, 858 aa, Unknown
  Obtained from environmental sample
  DOMAIN (443)...(659): Glycosyl hydrolase family 3 C terminal domain
  DOMAIN (143)...(367): Glycosyl hydrolase family 3 N terminal domain
MLSNRRLIRTIPLGAAAYSVLLGLAGCSQSTVATAPAVEPTASQAMVAQPQNWPRVDWPLPHDAALEARVDALLATMSVEEKVGQIVQGDIDSITPEDLRKYRLGSILAGGNSDPGRKYNAAPSEWLALADAFWEASMDTSGGGKAIPVIFGIDAVHGQSNIVGATLFPHNIGLGATRNPDLIREIGRITAVETRVTGMEWTFAPTVAVPQDDRWGRSYEGYSESADVVASFAPAMVEGLQGMAGAADFLDDHHVMTSIKHFLGDGGTRDGKDQGDTLASEAQLRDIHAAGYITGIAAGAQAVMASYNSWHGEKMHGRRDLLTDVLKGRMDFGGFVVGDWNGHGQVAGCTNTDCPASFNAGLDMAMAPDSWKGLYESTLAHVKAGTIPMQRLDDAVRRILRVKFRMGLFEKPRPSQRALGGKFELLGAPEHRAVARQAVRESLVLLKNQNGLLPLSPNQRLLVAGDGANDLGKQSGGWTLNWQGTGTTRADYPNADSIWEGLKAQVEAAGGQAELAVDGQYRNRPDAAIVVFGENPYAEFQGDIPNLLYRPGDDGDLELIRRLKAEGIPVVAVFLSGRPLWMNREINAADAFVAAWLPGSEGGGVADVLLRGADGKVQHDFKGKLSFSWPRRADQFDNNVGQENYDPLFAFGYGLTYADDGDVAPLSEDSGISGQVSQANVFFSHGVASQGLRLRLIGADGGIADVMHPQAKTADGTLVLSAIDYQRQEGARRLVWTGRATAELLSTTPLDLGRETNGDVKIVATLRIDALPADGDVALIARSGDRSAELPIGDWFASLPRGQWLSAGVLLKCLRVAGSDTAKLDAPFSIRGSAGLELALAQVVAATADDTHLDCPIQ

SEQ ID NO: 5 - DNA, 2139 bp, Unknown
  Obtained from environmental sample
atggctgagaatttacgacctatctatctcgattcgtcgcgctcgatcgctgaacgcgttcaggatttgctttctcgcatgacactggatgaaaaaatcagccagatgagtaatgcggtctccgccataccacgcctgaacatgccagcctacgacttctggagtgaagccctgcatggagtcgccaggaatggcaaggcgaccgtcttcccacaggccatcggcatggctgccacctgggaccctgccttagtgcggcgtattggaaacgcaatcagcgatgagggccgagcaaaataccacgctgctctgaaaaggcgagccttcacaggtcagtatcaaggcctgtgtttttggagcccaaacattaaccaggaccgggacgttcgttggggaagaggacaggagacctacggagaagatccttacctcacgggtgaattgggtgtagcatttgtgcgcggcattcagggtgaccatcccaggtatttgaaggctgccgcgtgtgccaagcatttcgctgtccattctggtccggaagcacttcgccatgtctttaatgccgtcccctccagtcgtgatctgcaggatacctatctgccggcctttaaaaagttggttcaagaaggcaaagttgaatcggtgatgggcgcttacaatgcggtttacggcgtcccttgcaatgccagcgagttcttgctcaatcaaacactccgaaaagagtggggatttgaaggtcatgtcgtctcagactgcggtgccatcaccgatctccaccgcagccataaatacaccaaggacgctgccgaatcagcagcgatggcaattaaggcagggtgcgacctatcttgtgaccatgtttattacgagagcattggcgaggctgtcgaacgaggccttctgagtgtagccgatgtagatcgggctctagcccgcaccttgagtacgcgcttcaagctgggcatgtttgatcctgatgagatggttccgtatgcttcgatcccgttgagcgtgatcgacagcccagaacatcgacagttggcctacgaggcggcagtcaagtcggtggtgctgctcaaaaacaaaaacgacatcttgcctattgcacctgagaccacttcgataatggtcgcgggtccaaatgcggcggttgtaaatgtcctgcttggtaattattatggcttcaacggccgcatggtcactgtgttggaagggatcaccgatgcgctgccggagggcatgggcatggaatatcaccagggtatgatgctgacagataccggcacaacgcctgacaactggtcaatcggtatggctgccagggctggactgaccatagcctgtatgggtatctcacccttgatggaaggtgaagagggcgaggcgctgctcgttgaacacggtggtgaccgtagttcaatcgagctgcccaaagctcaggtcgattacctgcggaagttgaacatcgccggagccaggatcgtgctggttctgtttggtggcagtgcaatagcgctgggcgaagccgaagatctggtcgaagcgattatccatgtctggtatcctggcgaggaaggtggtcatgctgtagcggatatcctgttcggcaaggctaccccatccggcaaactacccattacctttcccaaggccaccagccagcttccgccctttgaagattacagcatgaaagacagaacctaccgctacgcaacctgggagccgctctatccgtttggattcggattgagttacacgacttttgcttactcggatctaaaactcgaccagtctaccctcaaagctggcgattcgcttgaggtttccctaaggctgaccaatacaggtgaattagccggcgaagaagtagttcaggtctatataacagatctcgaggcttcaaacgtcgtgcctatccacaagctggcagcattccggcgtgtagctctacagcccggtgagagccagttgctttccttcagcatcgctccagaatcgatgatgttcgtagacgatgatggcaatcagcagcttgagccaggcgatttccggctgacgatcggtggcagttcgcctggccagcgtagccagacattaggtgcgcccgaaccattgagcgacaccttctccgttcaataa

SEQ ID NO: 6 - protein, 712 aa, Unknown
  Obtained from environmental sample
  DOMAIN (356)...(587): Glycosyl hydrolase family 3 C terminal domain
  DOMAIN (40)...(285): Glycosyl hydrolase family 3 N terminal domain
MAENLRPIYLDSSRSIAERVQDLLSRMTLDEKISQMSNAVSAIPRLNMPAYDFWSEALHGVARNGKATVFPQAIGMAATWDPALVRRIGNAISDEGRAKYHAALKRRAFTGQYQGLCFWSPNINQDRDVRWGRGQETYGEDPYLTGELGVAFVRGIQGDHPRYLKAAACAKHFAVHSGPEALRHVFNAVPSSRDLQDTYLPAFKKLVQEGKVESVMGAYNAVYGVPCNASEFLLNQTLRKEWGFEGHVVSDCGAITDLHRSHKYTKDAAESAAMAIKAGCDLSCDHVYYESIGEAVERGLLSVADVDRALARTLSTRFKLGMFDPDEMVPYASIPLSVIDSPEHRQLAYEAAVKSVVLLKNKNDILPIAPETTSIMVAGPNAAVVNVLLGNYYGFNGRMVTVLEGITDALPEGMGMEYHQGMMLTDTGTTPDNWSIGMAARAGLTIACMGISPLMEGEEGEALLVEHGGDRSSIELPKAQVDYLRKLNIAGARIVLVLFGGSAIALGEAEDLVEAIIHVWYPGEEGGHAVADILFGKATPSGKLPITFPKATSQLPPFEDYSMKDRTYRYATWEPLYPFGFGLSYTTFAYSDLKLDQSTLKAGDSLEVSLRLTNTGELAGEEVVQVYITDLEASNVVPIHKLAAFRRVALQPGESQLLSFSIAPESMMFVDDDGNQQLEPGDFRLTIGGSSPGQRSQTLGAPEPLSDTFSVQ

SEQ ID NO: 7 - DNA, 2265 bp, Unknown
  Obtained from environmental sample
atgaaccgggaagtccccactgtttcgccacgaccgctgctggtcggcatgatcgctgtcctgctggcggcaccggccgccgccaagccgccggcctacgcgacgccggccgaaaaagccttcgtcgacgccctgatggcgaagatgacggtcgaggagaagctgggccagttgaaccagccggccggggtgggcaacaacaccggcccggcggccatgaccggcaacgaggaccagatccgcaagggcgagatcggcacctatctgggtacccagggcgcggtgctgacctgccgcctgcagcggatcgcggtggagcagtcccggctgggcatcccgctgatgttcggctacgacgtgatccacggccaccgcaccgtcttcccggtgccgctgggcgagtccgccagcttcgatccggtcgaagtgcagcatgccgcccgtgtggcggcgatcgaggcctcggcgcacggcatccactggacctacgcgccgatggtcgacatcgcgcgtgatccgcgctggggtcgcgtggtggaaggcgcgggcgaagatccctatctgggatcggtactcgcggcggcgcgcgtgcgcggcttccagggcgatgacctgcgcaagccggatgcggtgctggccacggccaagcacttcgtcgcgtacggcgcggccgagggcggccgcgattacgacgtggccgacatttccgaacgcacgctgcacgaggtctacctgccgccgttcaaggccgcggtcgatgccggcgcgcaatccatcatggccgcgttcaacgagatcgccggcgtgcccatgcacgcgcaccggccgctgatcgaggatctgctgcgcaaggagtggggctgggacggcctgctggtcagcgattacaccggcgtgatggaactgatgccgcacggcatcgccgccgaccgcaagcaggcgggtgcgctcggcctgcgtgccggcgtcgacgtcgacatggtcagccagatctacgtgaaggacctgccggccgaagtgaaggcgggccgggtgccgatggcccaggtggatgcgtcggtgcgccgtgtgctcaacgcaaagtaccggctgggcctgttcgacgatccctaccggtcctgcaccgacgatggcgcgcacgagcgcgcgatgacgctgacgccggagcaccgcgccgacgcacgccggatggcgcagaaatcgctggtgctgctggagaacggcaacgacgtgctgccgctgtcgaagtcggtccgcacgctggcggtgatcggcccgctcgccgaccatcgccgcgcgatgctcggcaactgggcggtggccggtcgcgaagaggacgcggtgacgccgatcgagggcctgaaggccgcgctgggtgacggtacccggctggtgatcgcgaagggcgccgacatcgacagccaggacacgtccggtttcgcgcaggccgtcgcggcggcgaagcaggccgatgcggtggtgatgttcctcggcgaacacccggacatgagcgcggaagcgaacaaccgcacctcgctggacttgcccggcgtgcaggaacaacttgcattggcggtcgccgcgaccggcaagccggtggtggccgtgctgttgaacggacgcccgctgtcgatcggtggcctgaagggcaaggtgccggcgatcctcgaagcctggttccccggggtcgagggcggtcatgcgatcaccgacgtactgttcggcgacgtcaatccgtcggccaagctgccggtgacgttcccgcacaacgtcggccaggtgccgatctactacgcgcacaagaacaccggccgtccgccgagcgagcaggagaaatacaccagcaagtacctcgacgtgccgtggacgccgctgtacgccttcggccacggactcagctacaccacgttccgctacgacgcgccggtcgtggcgaagaagacgctggcgccttccgccctgcagcagcaggtgagcgtgcgcatcaccaacaccggcaagcgggagggcgtcgaggtggtgcaactgtatgtgcgggacgatgtcgccaccgtcacccgtccggtgaaacagttgcgcggcttccagcgcgtgtcgctggcgcctggcgaatcgaagacggtcacgttcgacctcggcttcgaggatctggcgatgtacgacgaccgcatgcagcaggtggtggagccgggcacgttcaccgtgtatgtcggcggcagttccgaccgcacgcgtgaggtcgctttcgaggtcgccgcccaatag

SEQ ID NO: 8 - protein, 754 aa, Unknown
  Obtained from environmental sample
  SIGNAL (1)...(28)
  DOMAIN (402)...(636): Glycosyl hydrolase family 3 C terminal domain
  DOMAIN (104)...(328): Glycosyl hydrolase family 3 N terminal domain
MNREVPTVSPRPLLVGMIAVLLAAPAAAKPPAYATPAEKAFVDALMAKMTVEEKLGQLNQPAGVGNNTGPAAMTGNEDQIRKGEIGTYLGTQGAVLTCRLQRIAVEQSRLGIPLMFGYDVIHGHRTVFPVPLGESASFDPVEVQHAARVAAIEASAHGIHWTYAPMVDIARDPRWGRVVEGAGEDPYLGSVLAAARVRGFQGDDLRKPDAVLATAKHFVAYGAAEGGRDYDVADISERTLHEVYLPPFKAAVDAGAQSIMAAFNEIAGVPMHAHRPLIEDLLRKEWGWDGLLVSDYTGVMELMPHGIAADRKQAGALGLRAGVDVDMVSQIYVKDLPAEVKAGRVPMAQVDASVRRVLNAKYRLGLFDDPYRSCTDDGAHERAMTLTPEHRADARRMAQKSLVLLENGNDVLPLSKSVRTLAVIGPLADHRRAMLGNWAVAGREEDAVTPIEGLKAALGDGTRLVIAKGADIDSQDTSGFAQAVAAAKQADAVVMFLGEHPDMSAEANNRTSLDLPGVQEQLALAVAATGKPVVAVLLNGRPLSIGGLKGKVPAILEAWFPGVEGGHAITDVLFGDVNPSAKLPVTFPHNVGQVPIYYAHKNTGRPPSEQEKYTSKYLDVPWTPLYAFGHGLSYTTFRYDAPVVAKKTLAPSALQQQVSVRITNTGKREGVEVVQLYVRDDVATVTRPVKQLRGFQRVSLAPGESKTVTFDLGFEDLAMYDDRMQQVVEPGTFTVYVGGSSDRTREVAFEVAAQ

SEQ ID NO: 9 - DNA, 1590 bp, Unknown
  Obtained from environmental sample
atgtctgccttgaactctttcaatatgtacaagagcgccctcatcttgggctccttgctggcaacagctggtgctcagcaaattggtacttataccgctgaaacccatccctctctgagctggtctacttgcaaatcgggtggtagctgcaccacaaactccggtgccattacgttagatgccaactggcgttgggtccatggtgtcaataccagcaccaactgctacactggcaacacttggaatagcgccatctgcgacactgatgcatcctgtgcccaggactgtgctctcgatggtgctgactactctggcacgtacggtatcactacctccggcaactcattgcgcctgaacttcgttaccggttccaacgtcggatctcgtacttacctgatggccgataacacccactaccaaatcttcgacttgttgaaccaggagttcaccttcaccgtcgatgtctcccacctcccttgcggtttgaacggtgccctctacttcgtgaccatggatgccgacggtggcgtctccaagtaccccaacaacaaggccggtgctcagtacggtgttggatactgtgactctcaatgtcctcgtgacttgaagttcatcgctggtcaggccaacgttgagggctggacgccctccgccaacaacgccaacactggaattggcaatcacggagcttgctgcgcggagcttgatatctgggaggcaaacagcatctcagaggccttgactcctcacccttgcgatacacccggtctatctgtttgcactactgatgcctgcggtggtacctacagctctgatcgttacgccggtacctgcgaccctgatggatgtgacttcaacccttaccgtcttggtgtcactgacttctacggctccggcaagaccgttgacaccaccaagccctttaccgttgtgactcaattcgtcactaacgacggtacctccaccggttccctctccgagatcagacgttactacgttcagaacggcgttgtcatcccccagccttcctccaagatctccggaatcagcggaaatgtcatcaactccgactactgcgctgctgaaatctccacctttggcgggactgcctccttcagcaaacacggtggcttgacaaacatggccgctggtatggaagctggtatggtcttggtcatgagtttgtgggacgactacgccgtcaacatgctctggctcgacagcacctaccctacaaacgcaactggtacccccggtgccgctcgtggtacctgcgctaccacttctggggaccccaagaccgttgaatcacaatccggcagctcctatgtcacattctctgacattcgggttggtcctttcaattctacgttcagcggtggttctagcaccggtggcagcactactactaccgccagccgcaccaccaccacctcggcctcttccacctctacttccagcacctctactggcactggagtcgctggtcactggggtcagtgtggtggccagggctggactggtcctaccacctgtgttagtggaaccacatgcaccgtcgtgaacccttactactctcaatgtttgtaa

SEQ ID NO: 10 - protein, 529 aa, Unknown
  Obtained from environmental sample
  DOMAIN (497)...(525): Fungal cellulose binding domain
  DOMAIN (27)...(460): Glycosyl hydrolase family 7
MSALNSFNMYKSALILGSLLATAGAQQIGTYTAETHPSLSWSTCKSGGSCTTNSGAITLDANWRWVHGVNTSTNCYTGNTWNSAICDTDASCAQDCALDGADYSGTYGITTSGNSLRLNFVTGSNVGSRTYLMADNTHYQIFDLLNQEFTFTVDVSHLPCGLNGALYFVTMDADGGVSKYPNNKAGAQYGVGYCDSQCPRDLKFIAGQANVEGWTPSANNANTGIGNHGACCAELDIWEANSISEALTPHPCDTPGLSVCTTDACGGTYSSDRYAGTCDPDGCDFNPYRLGVTDFYGSGKTVDTTKPFTVVTQFVTNDGTSTGSLSEIRRYYVQNGVVIPQPSSKISGISGNVINSDYCAAEISTFGGTASFSKHGGLTNMAAGMEAGMVLVMSLWDDYAVNMLWLDSTYPTNATGTPGAARGTCATTSGDPKTVESQSGSSYVTFSDIRVGPFNSTFSGGSSTGGSTTTTASRTTTTSASSTSTSSTSTGTGVAGHWGQCGGQGWTGPTTCVSGTTCTVVNPYYSQCL

SEQ ID NO: 11 - DNA, 1395 bp, Unknown
  Obtained from environmental sample
atgcagagaacatcagcttgggcactgctccttctggcgcagattgccactgctcagcagaccgtctggggacaatgtggtggtatcggctactctggaccgaccagctgtgttgcaggatcttcttgtagcacccagaactcttactacgcccaatgtctcccgggcagtggaaacggcggtggcggtgcggcaaccacgaccacgactgctggacaaaccaccaagaccaccatggccaccaccaccaccacttcaaccaagacctcagctggtagtggcggcagcaccactactgctcctcctgctagcaacagtggcaaccccttcaagggataccagccttacgtgaacccgtactacgcttccgaggttcagagcctggctattccctctctggcagcctctctggcgcccaaggccagcgcggtggccaaggtcccatccttcgtttggctggacactgctgctaaggtccctactatgggcacttacttggcagacatcaaggccaagaacgcggctggtgctaacccacccattgccggtatctttgtcgtttacgatcttcctgaccgtgactgcgctgctcttgccagtaacggcgagtactccatcgccaacggcggtgttgccaactacaagaagtacattgactcgatccgcgctcagcttctcaagtaccctgatgtgcacaccatcctggtcatcgaacccgacagtctcgccaacctggtcaccaacatgaacgtcgccaaatgctcgggtgctcacgacgcctacctggagtgcactgactatgcactcaagcagctcaacttgcccaacgttgccatgtaccttgatgccggacacgctggctggcttggatggcccgccaacattggacccgctgccgacctcttcgccagtgtgtacaagaatgccggctctcccgccgccgtccgtggattggccaccaacgttgccaactacaacgcctggtccatctccacctgcccatcttacactcagggtgaccagaactgtgacgagaagcgctacatcaacgccctcgctcctctcctccgcgcgaacggcttcgacgcccacttcatcatggacacctcccgtaacggtgtccagcccactaagcaacaagcctggggtgactggtgcaacgtcattggcactggcttcggtacccccttcaccaccgacactggtgatgctcttcaggacgctttcatctgggtcaagcccggtggcgagtgtgacggtacctcggacacatcctctcctcgctacgacgcccactgcggatacagcgatgccctcgagccggcccccgaggctggaacttggttccaagcctacttcgagcagctgctcgtcaacgccaacccaagcttctaa

SEQ ID NO: 12 - protein, 464 aa, Unknown
  Obtained from environmental sample
  SIGNAL (1)...(18)
  DOMAIN (22)...(50): Fungal cellulose binding domain
  DOMAIN (117)...(431): Glycosyl hydrolases family 6
MQRTSAWALLLLAQIATAQQTVWGQCGGIGYSGPTSCVAGSSCSTQNSYYAQCLPGSGNGGGGAATTTTTAGQTTKTTMATTTTTSTKTSAGSGGSTTTAPPASNSGNPFKGYQPYVNPYYASEVQSLAIPSLAASLAPKASAVAKVPSFVWLDTAAKVPTMGTYLADIKAKNAAGANPPIAGIFVVYDLPDRDCAALASNGEYSIANGGVANYKKYIDSIRAQLLKYPDVHTILVIEPDSLANLVTNMNVAKCSGAHDAYLECTDYALKQLNLPNVAMYLDAGHAGWLGWPANIGPAADLFASVYKNAGSPAAVRGLATNVANYNAWSISTCPSYTQGDQNCDEKRYINALAPLLRANGFDAHFIMDTSRNGVQPTKQQAWGDWCNVIGTGFGTPFTTDTGDALQDAFIWVKPGGECDGTSDTSSPRYDAHCGYSDALEPAPEAGTWFQAYFEQLLVNANPSF

SEQ ID NO: 13 - DNA, 1377 bp, Unknown
  Obtained from environmental sample
atggacatgatgatgacccgactcactttccccgccggtttcgtgtggggcgcggcgacttcttcctatcaaattgagggcgcatgggatgaggatggcaagggcgaatccatttgggatcgttttgcccacaccccaggcaaggtgatcgatggctcgaatggcgatgtcgcatgtgaccactatcatcgctatcgcgaagatgttgcgctgatggccggcctcggcttgcaagcctatcgattttcggtggcatggccgcgcatcctgcccgaaggtcgaggacgcgtcaaccaggcaggactcgacttttacagccggctggtcgacgaactgcttgccgccaacatgaccccgtttgccaccctctatcactgggatttgccccaggcattgcaggatcagggtggttggcctgcgcgtgccactgccgaagcctttgtcgaatatgccgacgtgatctcgcgccatttgggcgaccgcgtcaaacagtggatcacccacaatgagccgtggtgtgtggcgctcttgagccaccagatcggcgaacacgcgcccggctggcaagattggcccgccgcactgctggccggacatcacgtacttctctcgcatgggtgggctgtgcctgtcattcgtgccaacatcccagacgctgaggtaggtataacgctaaacttcaccccggctgttgccgcctcaccgagccgcgccgattttgaggcaacacgctggttcgacggctattacaaccgctggttcctcgatgcgctctatggccgcggctatcccgcagacatggtggcggactatagcaaggcggggcatctgcccaatggccctgactttgtgcattccaatgacctcgctgccattgccgcgctgaccgatttcctgggcgtcaatatgtacacgcgtgaggtcgtgcgcgcagcggacgcaccagataatttgccgcgcacacgctttgccgcgccggcggaggaacacaccgaaatggggtgggaggtgcatcccgacagcctctatcgtttgctgttgcggctgggcacgaactatccaattgaaaagctctatattacggagaatggtgcgagctatggggatgggccggacgctgaggggcgcatccatgaccaacggcgcattgactatttgcgcgaccacttggccgcgtgtcaccgcgcgattgaggccggggtgccgctgcaaggctatttccagtggagcttactggacaattttgagtgggcgaggggctatacccagcgttttggcatggtgtgggtagactttgctacacagcagcgtataccgaaggccagcgccgagtggtatcgcgaggcaatccgccacaatggttttgctgttgagtag

SEQ ID NO: 14 - protein, 458 aa, Unknown
  Obtained from environmental sample
  DOMAIN (6)...(455): Glycosyl hydrolase family 1
MDMMMTRLTFPAGFVWGAATSSYQIEGAWDEDGKGESIWDRFAHTPGKVIDGSNGDVACDHYHRYREDVALMAGLGLQAYRFSVAWPRILPEGRGRVNQAGLDFYSRLVDELLAANMTPFATLYHWDLPQALQDQGGWPARATAEAFVEYADVISRHLGDRVKQWITHNEPWCVALLSHQIGEHAPGWQDWPAALLAGHHVLLSHGWAVPVIRANIPDAEVGITLNFTPAVAASPSRADFEATRWFDGYYNRWFLDALYGRGYPADMVADYSKAGHLPNGPDFVHSNDLAAIAALTDFLGVNMYTREVVRAADAPDNLPRTRFAAPAEEHTEMGWEVHPDSLYRLLLRLGTNYPIEKLYITENGASYGDGPDAEGRIHDQRRIDYLRDHLAACHRAIEAGVPLQGYFQWSLLDNFEWARGYTQRFGMVWVDFATQQRIPKASAEWYREAIRHNGFAVE

SEQ ID NO: 15 - DNA, 2331 bp, Unknown
  Obtained from environmental sample
atgaaaattcgctcgcttctgctgctcatttcgatcctcctcggtgtagtttcgcctgggtttggccagtcggtgctcgacagcgatacgatctttcgcgaggtttcacgacggccgatgaggcctaataacgaggcccggatcgaagcgctcatacgacagatgacggtcgaagaaaaggtcggccagatgacgcagctcacgatcgatatggtcacgagcggcgatgatcaggcggtacagatcgacaacgcaaagcttgaaaaggcggtcgttcaatacggcgttggttcgatcctcaacgtcaacaatcaggctttaacactcgatcattggcatcggatcattgggccgatccagcaagcggctcagcggactcggctgaagatcccggtcatttacggtgtcgattcgatccacggagcaaactacgttcagggctcaacgctgtttccgcaagagctcggaatggcgtcgacttggaatccaaatttgatgcgatgggcggcggagatcacggcgaaggaaacgcgggcggccggcatcccctggagcttttcacccgttctcgacgttggccgaaatcaagcatggccgcgattgtgggaaacgttcggcgaagatccgtatctggcgacagtgatgggaaccgcattcgtacgcggtctcgaaggcgatgatgttgcgagcggcaagcacgtcgccgcgagcctaaagcactacgtcggatacagcatctcgacgaccggccgcgatcgcacgcccgctgtcattccagagcattaccttcgcgaatatttgctgccgccgtttgctgcggcagtaaaggctggagccaggacggtgatgatcaactccgccgagatcaacggagttccgggtcacatcaacaagcacctgatgaccgatgtcctcaagggcgaacttggctttgacggtttcattgtttcggattgggacgacattaaaaagctcgtttcgcaatggcgcgtcgcggccgatgaaaaagaagccacgcggctcgcggtgatggccggcatcgatatgagtatggtgccgctgagctacagtttctcagatcatctgatcgccctagtgaaagaaggtaaggttccgatgtcgcggatcgacgacgcggttcgccgcattcttcgcgtgaaattcgaacttggattgttcaagaatgcgatgccggatccgtcgcttcgttcaaatcacggcagccccgaatacaccgccgtggctgccgcagcggctcgcggatcgatcattctcctcaagaatcaaaacaacattcttccactgtcgaaaacggccaaggtccttgtcaccggcccgacagctgactcaatgatctcgctaaataacggctggacatacgtctggcagggctcggagccgtcgctctacccgaaggataagccgacgatccagaaggcgatcgaagcaaagaccggtccggcaaacttcaagtatgtaccgggaacgcgactcgttcgccgagccggcagtccgtcgaacagcaacccgactgacattgatgaggaagtggatatcgccgccgctgtccaggccgcgaagtcgagtgatgtcgtcgttctctgcctgggtgaaggttcgtacaccgagcatcccggaagcatcgcggatctcaccttgcccgagcttcaacttcagttcgccgagcgaatgatcgccacggggaagccgatagtacttgtattgtcgcaaggccgtcctcgtgtgatcagccgcattgcggacagggtcgccgggatagtcctcgcgttcaatcccggcaacgaaggtggccgtgcgttcgctgacgttttattcggcgactataatccggatggaaagttgccggtaacatatcctcgctcgcccggatatctcacgacctacgacgaaaacatcttcgaacgtgtaatggacgcacgaaaagcgctgacatttcaaccgcagttcgagtttggatacggtttgagctatacgacctttagctactcgaatataaaactcgcctccgaccgaatgcagcgaaatggaactctgtcattctccgtcgatgtagccaacaccggaaaacggcggggaactgagacggtcatcgtctacgtccgcgacgaagtcgccgggctaacgccggccgcaaagcgtgtcagaagattcgcaaaaggaaatttggagccgggagaatcgaagacgttcaatttcacactacgtcccgatgatctcggatacttcggactcgacaacaaactgcagatcgagccgggcgagttcacgatcatgatcggcgatcgaaccgccaagttcacgttggaataa

SEQ ID NO: 16 - protein, 776 aa, Unknown
  Obtained from environmental sample
  SIGNAL (1)...(22)
  DOMAIN (122)...(352): Glycosyl hydrolase family 3 N terminal domain
  DOMAIN (423)...(666): Glycosyl hydrolase family 3 C terminal domain
MKIRSLLLLISILLGVVSPGFGQSVLDSDTIFREVSRRPMRPNNEARIEALIRQMTVEEKVGQMTQLTIDMVTSGDDQAVQIDNAKLEKAVVQYGVGSILNVNNQALTLDHWHRIIGPIQQAAQRTRLKIPVIYGVDSIHGANYVQGSTLFPQELGMASTWNPNLMRWAAEITAKETRAAGIPWSFSPVLDVGRNQAWPRLWETFGEDPYLATVMGTAFVRGLEGDDVASGKHVAASLKHYVGYSISTTGRDRTPAVIPEHYLREYLLPPFAAAVKAGARTVMINSAEINGVPGHINKHLMTDVLKGELGFDGFIVSDWDDIKKLVSQWRVAADEKEATRLAVMAGIDMSMVPLSYSFSDHLIALVKEGKVPMSRIDDAVRRILRVKFELGLFKNAMPDPSLRSNHGSPEYTAVAAAAARGSIILLKNQNNILPLSKTAKVLVTGPTADSMISLNNGWTYVWQGSEPSLYPKDKPTIQKAIEAKTGPANFKYVPGTRLVRRAGSPSNSNPTDIDEEVDIAAAVQAAKSSDVVVLCLGEGSYTEHPGSIADLTLPELQLQFAERMIATGKPIVLVLSQGRPRVISRIADRVAGIVLAFNPGNEGGRAFADVLFGDYNPDGKLPVTYPRSPGYLTTYDENIFERVMDARKALTFQPQFEFGYGLSYTTFSYSNIKLASDRMQRNGTLSFSVDVANTGKRRGTETVIVYVRDEVAGLTPAAKRVRRFAKGNLEPGESKTFNFTLRPDDLGYFGLDNKLQIEPGEFTIMIGDRTAKFTLE

SEQ ID NO: 17 - DNA, 1419 bp, Unknown
  Obtained from environmental sample
atgaaacggtttcctgacaacttcgtgtggggtgctgccacctccgcctatcagatcgagggcgcggtccgcgaagacggccgtggcgagtcaatctgggatcgattcgccgccgagcccggccgcatcagcgatggctccgacgccagcgtcgcctgcgatcactaccggcgcgtcggcgaggacgtcgagatcctcgagtggctcggggtccgcgcgtatcggttctcgatcgcgtggccgcgtgtgctgccgagcggccgcggcaccgtcaacacggcgggcctcgacttctacgatcgtctcgtcgatcgcttgctcgcgagcggcatcgagccattcgtcacgctcaaccattgggacctgccgaccgcgctccacgatgaaggaagctggccgtcgcgcgacaccgtcggtgcgttcgtcagctacgcagagatcgtgatgcggcgcctcggcgatcgcgtccgccgcgtgtgcactcacaacgagccgtggtgcatcagcacgctcggcttcggcaacggcgagcatgcgcccggcgaacggtcgtggccgcgcgcgctcgccgctgcgcatcacttgctgctctcgcacggcctcgccgtccaggcgatccgcgccgtcgcgcccgccgcgcaggtcggcatcgttctcaatctggtcccgaccgagcccgcctcgtcgagcgaagcggaccgcgacgcggcgcgcgcattcgacggcagcttcaaccgctggttcctcgatccgctctacggccgcggctacccgctcgacgtgatcgacgatcacattcgcgccggccacctcgccgacgccgagctcccgttcgtgcaggacggcgacctgcgcacgatcgcgacgcgcaccgactatctcggcatcaactactactcgcgcgcggtgatgcgttcgacggcggtgcccgaccacgacaacttgccgccgtcggtgatggcctccggcgagaagaccgacatgggctgggaggtcgcgcccagcggcctcgtcgcgatcctgcgccgtgtccacgcggactacgcgccgccgcggctctacatcaccgagaacggcgccgcgtacggcaccgcgcccgatgcgaatggccgcgtgcgcgatgtcgcgcgccagcgctatctatggagccacttcgccgccgcgcaccaggcgatcgcggaaggcatcccgctcgccggctacttcttgtggtcgctgctcgacaacttcgagtgggcccagggctacagcaaacgcttcggcttgttctgggtcgactacgaaacccaggcgcgcctggcgaaagactcggcgcacctgtgtcgccgcatcatccgcgacaacgcgctcaccgagctggagcacgatctcgcggcggtgaacgagaccgagcacgacctcgcggcggtgaacgcatga

SEQ ID NO: 18 - protein, 472 aa, Unknown
  Obtained from environmental sample
  DOMAIN (1)...(450): Glycosyl hydrolase family 1
MKRFPDNFVWGAATSAYQIEGAVREDGRGESIWDRFAAEPGRISDGSDASVACDHYRRVGEDVEILEWLGVRAYRFSIAWPRVLPSGRGTVNTAGLDFYDRLVDRLLASGIEPFVTLNHWDLPTALHDEGSWPSRDTVGAFVSYAEIVMRRLGDRVRRVCTHNEPWCISTLGFGNGEHAPGERSWPRALAAAHHLLLSHGLAVQAIRAVAPAAQVGIVLNLVPTEPASSSEADRDAARAFDGSFNRWFLDPLYGRGYPLDVIDDHIRAGHLADAELPFVQDGDLRTIATRTDYLGINYYSRAVMRSTAVPDHDNLPPSVMASGEKTDMGWEVAPSGLVAILRRVHADYAPPRLYITENGAAYGTAPDANGRVRDVARQRYLWSHFAAAHQAIAEGIPLAGYFLWSLLDNFEWAQGYSKRFGLFWVDYETQARLAKDSAHLCRRIIRDNALTELEHDLAAVNETEHDLAAVNA

SEQ ID NO: 19 - DNA, 1374 bp, Unknown
  Obtained from environmental sample
atgttgcgatatctttccatcgttgccgccacggcaattctgaccggagttgaagctcagcaatcagtctggggacaatgtggcggccaaggctggtctggcgcgacttcatgcgccgccggttctacgtgcagcactctaaacccttactacgcacaatgtatccctggtaccgctacttcaactacattggtgaaaacaacgtcttctaccagcgtcggaacgacatcgccgccaacaacaaccacgacgaaagctagtaccactgctactaccactgccgctgcatccggaaaccctttctctggttaccagctttatgccaatccgtactattcttcagaagtacacactcttgccatcccatctttgactggctcgctcgctgctgctgctaccaaagctgccgagatcccctcatttgtctggcttgacacggcagccaaagtgcctacaatgggcacctacttggccaacattgaggctgcaaacaaggctggcgccagcccacctattgccggtatcttcgttgtctatgacctgcctgaccgtgactgtgcagctgctgcaagtaatggcgaatacactgtagcaaacaacggtgttgcaaactacaaggcttacatcgacagcattgtggcacagttgaaagcttatcccgatgtgcacacaatccttatcattgagcctgatagtctcgccaacatggtcaccaatctgtctacagccaagtgtgctgaggctcaatctgcatactatgagtgcgtcaactacgcattgatcaacctcaacttggccaacgtggccatgtacattgatgctggtcatgctggttggctcggatggtctgcgaatctttcaccagcggctcaactcttcgcaacagtctataagaatgcaagtgcccctgcatctcttcgtggattggccaccaacgttgccaactacaacgcttggtcgatcagcagcccaccctcatacacatctggcgactccaactacgacgaaaagctctacatcaacgctttgtctcctctcctgacatctaacggctggcctaacgctcacttcatcatggatacttcccgaaacggtgttcaaccgactaagcagcaggcatggggtgactggtgcaatgtgatcggaaccggcttcggtgttcaaccgacaacaaatactggtgacccacttgaggatgcctttgtctgggtcaagccaggtggtgaaagtgatggtacatcaaacagttccgctactcgttacgatttccattgcggctacagtgatgcacttcaacccgcccccgaggctgggacttggttccaagcatactttgtccagcttttgacaaatgccaacccagctttggtctag

SEQ ID NO: 20 - protein, 457 aa, Unknown
  Obtained from environmental sample
  DOMAIN (23)...(51): Fungal cellulose binding domain
  DOMAIN (108)...(423): Glycosyl hydrolases family 6
MLRYLSIVAATAILTGVEAQQSVWGQCGGQGWSGATSCAAGSTCSTLNPYYAQCIPGTATSTTLVKTTSSTSVGTTSPPTTTTTKASTTATTTAAASGNPFSGYQLYANPYYSSEVHTLAIPSLTGSLAAAATKAAEIPSFVWLDTAAKVPTMGTYLANIEAANKAGASPPIAGIFVVYDLPDRDCAAAASNGEYTVANNGVANYKAYIDSIVAQLKAYPDVHTILIIEPDSLANMVTNLSTAKCAEAQSAYYECVNYALINLNLANVAMYIDAGHAGWLGWSANLSPAAQLFATVYKNASAPASLRGLATNVANYNAWSISSPPSYTSGDSNYDEKLYINALSPLLTSNGWPNAHFIMDTSRNGVQPTKQQAWGDWCNVIGTGFGVQPTTNTGDPLEDAFVWVKPGGESDGTSNSSATRYDFHCGYSDALQPAPEAGTWFQAYFVQLLTNANPALV

SEQ ID NO: 21 - DNA, 1338 bp, Unknown
  Obtained from environmental sample
atgcttacccttgctttcctctccctgctggctgcggccaatgcgcagaaggctggcacgctccagtcggagactcacccgcgtatgacctggtccaggtgctccgccggaggcagctgcaccaccaccaacggcgaggtcgtcatcgatgccaactggcgatggcttcatactgtcagcggttcgcagaactgctacgacggcaacaagtggaccagcgcctgctcctccgagtccgactgcagccagaactgcgccgtcgagggtgccgactactcgggcacctacggcgcgtccacgagcggcaacgccctgacgctcaagttcgtcaccacccaccagtacggcaagaacatcggctcccgcctgtacctcatggccagccagagccagtatcagatgttcaccctgctcaacaacgagctggcttttgatgtcgacctgtcccagatcgagtgcggtctcaatgctgccctctactttgttgccatggacgccgatggcggcatgtcccgtaactcggccaacacggccggcgctaagtttggtactggatactgtgatgctcagtgtgctcgtgatctcaagtttgttggtggcaaggcgaacagtgacggctggaagccctccgacaacgatgccaatgctggcgttggaaagtacggtgcctgctgcgccgagattgatatctgggagtccaacgctcactcctttgccctgactcctcacccttgcaccgagaacacctaccacgtctgcactgactccaactgcggtggaacttattcggacgaccgattcgccggaaagtgcgacgccaacggctgcgattacaacccttaccgcatgggtaataccgacttctacggcaagggcatgactgttgataccaccaagaagttcaccgtcgtgacctcgttccagcgcaacaacatgactcagtacctcgtccagaacggccgcaagttcctcatccccgcccccacggataccagcatctcggacagcagcagcatcacccccgagttctgtgacaatgtcttcaccgccttcgacgaccgcaaccgcttcgaggaggtcggtggctgggaccagctcaacgccgctctgtccattcccatggtgctcgtcatgtccatctgggacgaccactacgccaacatgctctggctcgactccatctacccccctgagaagaagggccagcccggcgctgcccgtggtcggtgccccgagaactctggcgttccctctgaggttgagtctcagtacgccaacgcccaagttgtctggtccaacatccgctggggccccgtcggctcgactgtccgtctctga

SEQ ID NO: 22 - protein, 445 aa, Unknown
  Obtained from environmental sample
  DOMAIN (17)...(445): Glycosyl hydrolase family 7
MLTLAFLSLLAAANAQKAGTLQSETHPRMTWSRCSAGGSCTTTNGEVVIDANWRWLHTVSGSQNCYDGNKWTSACSSESDCSQNCAVEGADYSGTYGASTSGNALTLKFVTTHQYGKNIGSRLYLMASQSQYQMFTLLNNELAFDVDLSQIECGLNAALYFVAMDADGGMSRNSANTAGAKFGTGYCDAQCARDLKFVGGKANSDGWKPSDNDANAGVGKYGACCAEIDIWESNAHSFALTPHPCTENTYHVCTDSNCGGTYSDDRFAGKCDANGCDYNPYRMGNTDFYGKGMTVDTTKKFTVVTSFQRNNMTQYLVQNGRKFLIPAPTDTSISDSSSITPEFCDNVFTAFDDRNRFEEVGGWDQLNAALSIPMVLVMSIWDDHYANMLWLDSIYPPEKKGQPGAARGRCPENSGVPSEVESQYANAQVVWSNIRWGPVGSTVRL

SEQ ID NO: 23 - DNA, 2289 bp, Unknown
  Obtained from environmental sample
atgaaagatattcagtcccttattgcccaaatgactcttgaagaaaaggctgcgctatgcactggtgccagcccctggacatcagtcccggtggaaaggctcggcatcccggagatgatcgtttccgacggcccgcatggtgtgcgccgcgtcccggatgtcaacgcgattgcagtcaaaagtctgcctgcgacctgcttccccacggcctcctgcctggcatccacctgggatgtggatttgatccggaagatgggggaagctttgggtgaggaatgcatcgctctgaatgtggatgtgctgcttggcccgggtgcaaatatgaaacgctcgccgctgggcggtcgcaacttcgaatatttttctgaggatccctatctggccggcgaaatggctgccagcatcatcaatggcatccagagcaagggtgtgggtacgtcactcaagcattatgccgccaacaaccaggaattccagcgcttcagcattagcgccgaagtggacgaacgtaccctgcgggagatctacctgcccgcctttgaaaaagccgtcaagcaggcccagccgtggacggtgatgtgctcgtacaacaaggtcaacggcacgtttgcatcggagcattaccatctcctgactgaaatcctgaagcaggaatggggcttcgagggcctggtcgtctcggactggggcgcggtgcgcgaccgtgtggccgcgctgaaaggcgggctggattgggaaatgcccggtccccaggaacgccgcgtcaaggccgtcgtggaagccgtccgctccggccagctcgacgaagccattctggacgagtccgtccgccgcatcctgcgcatcatcttcatggcccgagaaacacccaaaaacggatccttcgacgtcgacgctcatcatgagctggcccacaagattgccagcgaaggcatggtaatgctgaagaacaatggcatcctgcctctcaaggaccagcagcacattgcagtgatcggccatgcagccgagaacgctcacttccagggcggcggcagctcccacatcaacccgaccagggtggccgtcccgttcaaggagctgcaagctcaggcggggaatgccgagctgacctatgcggagggctatccgaccgacaaatccttccgccaggacatgatcgatcaggcagtgaagctcgcccaagctgccgatgtggccgtactgtatatcgccctgccgaccttcaaggaatccgaaggttatgaccgcccggatctggacctgaccgatcagcagatcgcgctgatcaaggctgtcgccaaggtccagcctaacacggtcgtcgttctgaacaacggtgcgccggtggcgatgagcgcctggatcgatgacgtggccgccgtgctcgaaagctggatgatgggacaggcaggcggtgcggcgattgcggatgtcctctttggcagggtcaacccatccggcaaactggccgagaccttcccactcaaactcgccgatacgcccgcgcatctcaactggccgggcggcgccggagaagtccgctatggcgaagggctgttcatcggctatcgctactatgatgccaaagaaatgccggtcctgttcccctttggacacgggttaagttacaccacgttctcctatagcaatgccaaagcgtcggcgaaaaccttcaaggatgtggacggactgacagtctcagtagatgttaccaatacaggcagcgtagcgggcaaggaaactatccaggtgtacgtccacgatcagaagtccgggctggtgcgaccgcaaaaggaactgaaaggcttcgcgaaagtggaacttcagccgggcgagaccaagaccgtctcgatcgacttggatttccgtgcctttgcctactatcacccggaatacaaacagtggattactgaggacggagagttcgacattctgatcggcgcctcctccgcggatattcgctgcaggctgactgtggcactcgaatcgaccctggacctgccctgcattctcgacaaggaatccaccatccgtgagtggctggccgacccgcgtggcaaagccatcctggagcccgaatacgccctgatcgaaacccggggccgcagaattctcggcggggaatcggagcgttatggcaatgatggcgccctgggcatggatgtcatggatatgttcaatgacatgccgctggtcagtgtgctgatgttccagcagggcgagctgcccatgccggcggaagaaatcgtggatggattactggcccgggttcatagcaagagctaa

SEQ ID NO: 24 - protein, 762 aa, Unknown
  Obtained from environmental sample
  DOMAIN (312)...(524): Glycosyl hydrolase family 3 C terminal domain
  DOMAIN (28)...(248): Glycosyl hydrolase family 3 N terminal domain
MKDIQSLIAQMTLEEKAALCTGASPWTSVPVERLGIPEMIVSDGPHGVRRVPDVNAIAVKSLPATCFPTASCLASTWDVDLIRKMGEALGEECIALNVDVLLGPGANMKRSPLGGRNFEYFSEDPYLAGEMAASIINGIQSKGVGTSLKHYAANNQEFQRFSISAEVDERTLREIYLPAFEKAVKQAQPWTVMCSYNKVNGTFASEHYHLLTEILKQEWGFEGLVVSDWGAVRDRVAALKGGLDWEMPGPQERRVKAVVEAVRSGQLDEAILDESVRRILRIIFMARETPKNGSFDVDAHHELAHKIASEGMVMLKNNGILPLKDQQHIAVIGHAAENAHFQGGGSSHINPTRVAVPFKELQAQAGNAELTYAEGYPTDKSFRQDMIDQAVKLAQAADVAVLYIALPTFKESEGYDRPDLDLTDQQIALIKAVAKVQPNTVVVLNNGAPVAMSAWIDDVAAVLESWMMGQAGGAAIADVLFGRVNPSGKLAETFPLKLADTPAHLNWPGGAGEVRYGEGLFIGYRYYDAKEMPVLFPFGHGLSYTTFSYSNAKASAKTFKDVDGLTVSVDVTNTGSVAGKETIQVYVHDQKSGLVRPQKELKGFAKVELQPGETKTVSIDLDFRAFAYYHPEYKQWITEDGEFDILIGASSADIRCRLTVALESTLDLPCILDKESTIREWLADPRGKAILEPEYALIETRGRRILGGESERYGNDGALGMDVMDMFNDMPLVSVLMFQQGELPMPAEEIVDGLLARVHSKS

SEQ ID NO: 25 - DNA, 1581 bp, Unknown
  Obtained from environmental sample
atgttctccaagactgctcttctgtcttccatcttcgccgctgcggcaacggcccagcaggtcggcacccttaccaccgagacccatccttcactgccaatgcagagctgcactgctgctggatcctgtacgactatcaatacggcggtgaccttggatgccaactggagatggctccacacaaccagcggctataccaactgctacactggcaacgcttggaacaccacgctttgccccgatggcaagacgtgtgctgctaactgtgccctcgacggcgccgattatcctggcacatacggtgtgactgctagtggcaatgctctcaagctcaacttcgtgaccaacggacagtactccaagaacattggctcgcggttgtacctcatggcctcggattccaagtaccagatgttcaagctattgaaccgggagttcacattcgacgtcgatgtctccaacctgccatgtggtctgaacggggccctttaccttgtcgagatggacgaggatggcggaatggccaagtattccaccaacaaggctggtgccaagtacggaactggctattgtgatacccaatgcccgcacgacatcaagttcatcaacggcgaggctaatgtggacggatggacaccgagctccaacgatgccaacgctggaaccggtacttacggatcttgctgccacgaaatggatatctgggaggcgaattccatctcagccgcctacactcctcacgtatgcagcaaggatggccaagtgcgctgctccggcattgactgcggagacggcgacaaccgctacaagggtatctgtgacaaggatggctgcgatttcaacagctaccgcatgggtgataaatccttctacggcaagggcctgaccgtcgacacgtctagcaagttcactgttgtcactcagttcatcaccaatgacggcaccgacacgggcacgctctccgaaattcgccgtatctacgtccagaatggcaaggtcatccagaacagcaataccaagattactggcgttaccaccaccaactccatcactgacaagttctgcacggagcagaagaccaccttcggcgataccaacaccttcagctccatgggcggcctaaagacgatgggtggaccccttggccgtggtatggtcctcgccctctccgtctgggacgaccactcagtcaacatgctctggcttgactccacctaccccaccgacaagagtgccgacactcccggcgtcggtcgcggtacctgcgcaatcacttccggtgttccgtctgacatcgaaacctcggctgccagctccagcgtcacctactcgaatatcaaggttggaaagctgaactcgacctacaccggcacctctactaacccctccaacccatcttcctctgccaagccagcctcgtcttccacttccgcaactggctccaccccatctaacccatctactggcggaaccgtcgctaagtggggacagtgcggtggcatcggatactctggcgccacaacttgcgtctctggaagcacctgccacaagatcaacgactactacagccagtgctactaa

SEQ ID NO: 26 - protein, 526 aa, Unknown
  Obtained from environmental sample
  DOMAIN (20)...(457): Glycosyl hydrolase family 7
  DOMAIN (494)...(522): Fungal cellulose binding domain
MFSKTALLSSIFAAAATAQQVGTLTTETHPSLPMQSCTAAGSCTTINTAVTLDANWRWLHTTSGYTNCYTGNAWNTTLCPDGKTCAANCALDGADYPGTYGVTASGNALKLNFVTNGQYSKNIGSRLYLMASDSKYQMFKLLNREFTFDVDVSNLPCGLNGALYLVEMDEDGGMAKYSTNKAGAKYGTGYCDTQCPHDIKFINGEANVDGWTPSSNDANAGTGTYGSCCHEMDIWEANSISAAYTPHVCSKDGQVRCSGIDCGDGDNRYKGICDKDGCDFNSYRMGDKSFYGKGLTVDTSSKFTVVTQFITNDGTDTGTLSEIRRIYVQNGKVIQNSNTKITGVTTTNSITDKFCTEQKTTFGDTNTFSSMGGLKTMGGPLGRGMVLALSVWDDHSVNMLWLDSTYPTDKSADTPGVGRGTCAITSGVPSDIETSAASSSVTYSNIKVGKLNSTYTGTSTNPSNPSSSAKPASSSTSATGSTPSNPSTGGTVAKWGQCGGIGYSGATTCVSGSTCHKINDYYSQCY

SEQ ID NO: 27 - DNA, 1188 bp, Unknown
  Obtained from environmental sample
atgctcctctcagccgccactctgatcgcatttgccgcgggcgccattggcgccccggcttccaccatcgacacagtggctccccgtcaggcacctggagcctgctcgagccctgtccagctggacgccaagaccaacgtctggacttcgtacacgctccaccccaacagcttctacagggccgaggttgaggcagcagccgcttccatgtcctccagcgatgctgccagggctctcaaggtcgcagacattggcactttcctctgggctgacaccatcgccaacattgaccgcgttgagccggcgcttcaagatgttccttgcaatcatatctttggtctggttgtctatgatctgcctggccgcgactgcgctgctaaggcgtccaacggagagctcccggttggtgcgatcaaccgatacaagactgagtacatcgacaagcttgccgctctcatcaagaagtactccaacactgcttttgctctcgttattgagcccgattcgctgcctaacctggtcaccaactccaatgtcgctgcctgccaacaatctgccgctgggtaccgtgagggtgttgcttatgccctcaagaccctcaacctccccaacgttgtccagtacatcgatgctggtcacggcggatggcttggctggaacgataacctccagcctggtgctagggagctcgccaatgcgtacaagaacgccggcagcccctcccagttccgtggctttgccaccaacgtcgccggctggaaccaatgggatgccgagcccggtgagttcgctggcgcgtctgatgcccaatggaacaaagcccagaacgagaagaagtatgttgagctctttggcgccgccctttccagcgccggcatgccaaaccatgccattgttgataccggacggagcggcaagcccggcggacgcaaggaatggggtgactggtgcaacgtcgtcaactctggatttggccgacggcccagctcctcgactggctctaccctcactgatgcctttgtctgggtcaagcctggcggtgaatcggatggcactagcgatacctctgctgctcgttatgattctttctgtggcaaggatgacgcctttaagccttctcctgaagcgggccagtggaaccaggccttcttcgagcagctgcttaacaatgccagcccagcattctga

SEQ ID NO: 28 - protein, 395 aa, Unknown
  Obtained from environmental sample
  SIGNAL (1)...(22)
  DOMAIN (55)...(362): Glycosyl hydrolases family 6
MLLSAATLIAFAAGAIGAPASTIDTVAPRQAPGACSSPVQLDAKTNVWTSYTLHPNSFYRAEVEAAAASMSSSDAARALKVADIGTFLWADTIANIDRVEPALQDVPCNHIFGLVVYDLPGRDCAAKASNGELPVGAINRYKTEYIDKLAALIKKYSNTAFALVIEPDSLPNLVTNSNVAACQQSAAGYREGVAYALKTLNLPNVVQYIDAGHGGWLGWNDNLQPGARELANAYKNAGSPSQFRGFATNVAGWNQWDAEPGEFAGASDAQWNKAQNEKKYVELFGAALSSAGMPNHAIVDTGRSGKPGGRKEWGDWCNVVNSGFGRRPSSSTGSTLTDAFVWVKPGGESDGTSDTSAARYDSFCGKDDAFKPSPEAGQWNQAFFEQLLNNASPAF

SEQ ID NO: 29 - DNA, 1251 bp, Unknown
  Obtained from environmental sample
atggctgatgcatccgtttttccagaaaattttttgtggggtgtggcgggcgcggcgcaccagatcgaaggcaataatgtcaacagcgactcgtgggtgctggaacacatccccggcgggccattcgccgagccagcgggcgatgcctgtgaccactatcaccgctacccccaagacatcgccctcatcgcatcgctcggttttaacagctaccgcttctcgattgaatgggcgcggattgagccggaagaaggcgagttttccaacgctgagttggagcattaccgccggatgctggcggcctgccacgaacacggcctgacgccgattgtcacctatcatcatttcacctctccgcgctggttcgccgctaaaggcggatgggaagtcctcgccaatgccgattacttcgcccgctactgcgaaaaggcgacggcgcacctcggtgacctgatcggcgcggcctgcaccctcaacgaacctaatcttggcttgctcattcagagtatgggcttcacaccgccggatgaggttgttgctaaagcgccttatcgcgctgctgctgccaaagccgttggcagcgatcagttttcggcttttcccaactgtcagcatgggccagcgcgggatacctttctgaaggcgcacccgatggctgtcgcggcgattaaaagcgggcgcggcgatttcccggtaggcatcacactggcgatgtccgaccatcaggctgtccccggcggcgaggcgcatcgtgacaagttccgccatgatgtcgatgacatttttctcgatctggcgaaggatgatgatttcgtcggcgtacagacttacagccgcacccgtttcggcccggaagggatgctgcgcggcgaagaaggtgtcccggtgacgcagatgggctacgaattctggccggaagcgctggaaggcacgattcgttatgcggcggcttataccgggcgtccagtgctggtgacagagaacggcatcggcacggaaaatgacgccgatcgtatcgaatatgtgggcagggctttggcaggtgttagccgctgcttgcaggatggcatcgacgtgcgcggctactgctactggtcgattttcgacaattttgagtggggttttggctaccgtcccaaattcgggttgatcgccgttgaccgcgccacgcaggaacgagcacctaaacccagcgcggcatggctcggcgaaatcgcgcgttcaaaggggcaatttcagagtggtttctaa

SEQ ID NO: 30 - protein, 416 aa, Unknown
  Obtained from environmental sample
  DOMAIN (3)...(411): Glycosyl hydrolase family 1
MADASVFPENFLWGVAGAAHQIEGNNVNSDSWVLEHIPGGPFAEPAGDACDHYHRYPQDIALIASLGFNSYRFSIEWARIEPEEGEFSNAELEHYRRMLAACHEHGLTPIVTYHHFTSPRWFAAKGGWEVLANADYFARYCEKATAHLGDLIGAACTLNEPNLGLLIQSMGFTPPDEVVAKAPYRAAAAKAVGSDQFSAFPNCQHGPARDTFLKAHPMAVAAIKSGRGDFPVGITLAMSDHQAVPGGEAHRDKFRHDVDDIFLDLAKDDDFVGVQTYSRTRFGPEGMLRGEEGVPVTQMGYEFWPEALEGTIRYAAAYTGRPVLVTENGIGTENDADRIEYVGRALAGVSRCLQDGIDVRGYCYWSIFDNFEWGFGYRPKFGLIAVDRATQERAPKPSAAWLGEIARSKGQFQSGF

SEQ ID NO: 31 - DNA, 1338 bp, Unknown
  Obtained from environmental sample
atgtcttttcctagtaactttttatggggagcagcaactgctgcctatcagattgaaggcgctgtaaatgaggatggtcgtaaaccatgcatttgggataccttatcaaaagggcatgtagtttacgatgaaacaggagagaatgcctgtgaccattaccaccgctttgaagaagatattaagctgatgaaagagatcgggcttaaatgttatagattctcggttgcttggcctcgcatcatccctgatggcactggtgctgttaatgaaaagggtattgagttctatgtaaagcttgtaaagctgttaaaagaaaatgacattgaacctatcgttaccttatatcactgggatcttccatactcactttatttaaaaggtggttggacaaatcctgagatccaagagtggtttttagagtacacaaaggttgtagtaaaggctctatctccatatgtaaagtacttccttacatttaatgagcctcagtgttttatcggtatttcttatgtaggtggtgttcatgctccatttttagatgagcctacatcattattacctgctacaagaaatgtcttactagcacacggtaaagctgtaaaagctattagagagctagctccaaacgcaaaagtaggctttgctccaacaggtgctgtctatgcacctcacaaccacacagaatatgagtacaagaaagcttatgaacttactttctcagacagaagaggtccattctcagttgcttggtggtgtgatcctgtatttaaaggatctattactccacgcgcagcttcttacatgaatattgccccagagaattttatgacggaagttgagtggcagattgtaactgagaaattagatttcttaggctttaacttctatcagtgcgacggcattcaggaaaatggtcagaagtacccagacaatacattctgtggaggacctgtaactgctatgaactggcctattacacctgagggtatgtattacgcagttaagttcttaaaagagcgttatcaaagaccaattctgataacagaaaacggcatggcaaatactgattttgtaatgctagacggtaaagttcatgatccacagagaattgattatgttcaccgttatcttttagctttaaataaagctattgaagagggaatagaggtaattggctataactactggtcacttatggataactttgagtgggctgaaggttataaatatagatttggtcttatctatgttgattacagaactcaaaagaggacactaaaagactctgcttactggtataagaacgtaattgcttcaaatggagagaatttgttctag

SEQ ID NO: 32 - protein, 445 aa, Unknown
  Obtained from environmental sample
  DOMAIN (1)...(442): Glycosyl hydrolase family 1
MSFPSNFLWGAATAAYQIEGAVNEDGRKPCIWDTLSKGHVVYDETGENACDHYHRFEEDIKLMKEIGLKCYRFSVAWPRIIPDGTGAVNEKGIEFYVKLVKLLKENDIEPIVTLYHWDLPYSLYLKGGWTNPEIQEWFLEYTKVVVKALSPYVKYFLTFNEPQCFIGISYVGGVHAPFLDEPTSLLPATRNVLLAHGKAVKAIRELAPNAKVGFAPTGAVYAPHNHTEYEYKKAYELTFSDRRGPFSVAWWCDPVFKGSITPRAASYMNIAPENFMTEVEWQIVTEKLDFLGFNFYQCDGIQENGQKYPDNTFCGGPVTAMNWPITPEGMYYAVKFLKERYQRPILITENGMANTDFVMLDGKVHDPQRIDYVHRYLLALNKAIEEGIEVIGYNYWSLMDNFEWAEGYKYRFGLIYVDYRTQKRTLKDSAYWYKNVIASNGENLF

SEQ ID NO: 33 - DNA, 1527 bp, Unknown
  Obtained from environmental sample
atgtaccgcattctcgccaccgcctcggctctgctggcaaccgcccgtgcccagcaagcctgcaccctcaacgccgaaagcaagcctgccttgacctggtccaagtgcacatccagcggctgcagcaacgtccgcggatctgtcgtggttgacgccaactggcgatggacccatagcacctccagcagcaccaactgctacaccggcaacacctgggacaagactctctgccccgatggaaagacctgcgctgacaagtgctgtcttgatggtgccgactactctggcacctacggagtcacctcgagcggcaaccagctcaacctcaagtttgtgactgttggaccatacagcaccaatgttggcagccgtctctacctcatggaggatgagaacaactaccagatgttcgacctcctgggcaacgaattcacctttgatgtcgatgtcaacaacatcggatgcggcctgaacggcgccctctacttcgtctccatggacaaggatggtggcaagagccgcttcagcaccaacaaggctggtgccaagtacggaactggctactgcgatgcccagtgccctcgcgatgtcaagttcatcaacggagttgccaactccgacgactggcagccctccgccagcgacaagaacgccggtgttggcaagtacggcacctgctgccctgagatggatatctgggaggccaacaagatctccacggcttacactccccatccctgcaagagcctcacccagcagtcctgcgagggcgatgcctgcggtggcacctactcttctactcgctatgctggaacttgcgatcccgatggttgcgatttcaacccttaccgccagggcaaccacaccttctacggtcccggctccggcttcaacgttgataccaccaagaaggtgactgtcgtgacccagttcatcaagggcagcgacggcaagctctctgagatcaagcgtctctatgttcagaacggcaaggtcattggcaacccccagtccgagattgccaacaaccccggcagctccgtcaccgacagcttctgcaaggcccagaaggttgcattcaacgaccccgatgacttcaacaagaagggtggctggagcggcatgaacgacgccctcgccaagcccatggttctcgtcatgagcctgtggcacgaccactacgccaacatgctctggctcgactctacctaccccaagggctccaagactcccggctctgctcgtggctcttgccctgaggactctggtgtccccgccactctcgagaaggaggtccccaactccagcgtcagcttctccaacatcaagttcggtcccatcggcagcacctactccggcaccggcggcaacaaccccgaccccgaggagcctgaggagcccgaggagcctgtcggcaccgtcccccagtggggccagtgcggcggcatcaactacagcggccccaccgcctgcgtgtctccctacaagtgcaacaagatcaacgactactactcccagtgctactag

SEQ ID NO: 34 - protein, 508 aa, Unknown
  Obtained from environmental sample
  SIGNAL (1)...(20)
  DOMAIN (19)...(453): Glycosyl hydrolase family 7
  DOMAIN (476)...(504): Fungal cellulose binding domain
MYRILATASALLATARAQQACTLNAESKPALTWSKCTSSGCSNVRGSVVVDANWRWTHSTSSSTNCYTGNTWDKTLCPDGKTCADKCCLDGADYSGTYGVTSSGNQLNLKFVTVGPYSTNVGSRLYLMEDENNYQMFDLLGNEFTFDVDVNNIGCGLNGALYFVSMDKDGGKSRFSTNKAGAKYGTGYCDAQCPRDVKFINGVANSDDWQPSASDKNAGVGKYGTCCPEMDIWEANKISTAYTPHPCKSLTQQSCEGDACGGTYSSTRYAGTCDPDGCDFNPYRQGNHTFYGPGSGFNVDTTKKVTVVTQFIKGSDGKLSEIKRLYVQNGKVIGNPQSEIANNPGSSVTDSFCKAQKVAFNDPDDFNKKGGWSGMNDALAKPMVLVMSLWHDHYANMLWLDSTYPKGSKTPGSARGSCPEDSGVPATLEKEVPNSSVSFSNIKFGPIGSTYSGTGGNNPDPEEPEEPEEPVGTVPQWGQCGGINYSGPTACVSPYKCNKINDYYSQCY

SEQ ID NO: 35 - DNA, 1515 bp, Unknown
  Obtained from environmental sample
atgtatcagaaattggccgccatctcggccttcctggctgctgctcgtgctcagcaggtctgcacccaacaagcggagactcacccacctctgacatggcagaaatgcacagcttccggttgcacagctcaatcaggatccgtggttcttgatgccaactggcgttggactcacgataccaagagcactaccaactgctacgatggcaatacctggagctcaaccttgtgccccgacgatgcgacttgtgccaagaactgttgtttggacggagccaactactcaggcacttacggagtcaccaccagcggcgacgctctcaccattcaatttgttactcagtcgaatgtcggctcccgtctttacctgatggcaactgataccacttaccaggagttcacactgtctggcaacgagttctcctttgacgttgatgtttcccaactgccttgtggcttgaacggagcgctgtactttgtttccatggatgccgatggtggcaaaagcaagtaccccggcaatgctgccggtgccaaatatggcacaggttactgtgacagccaatgccctcgtgacctgaagttcatcaacggtcaggccaacgttgatggttggcaaccatcttccaacaacgccaacactggtattggtaaccacggaagctgctgctcagagatggatatctgggaggcaaactccatttctgaggctcttactcctcacccttgcgaggatgtcggccagacgatgtgcagcggcgattcttgcggtggaacctactccgatgaccgatatggcggaacctgcgaccctgatggctgcgactggaacccataccgcctgggtaacacctccttctacggacccggctcatcatttactctcgacaccaccaagaagttgaccgttgtgacccagtttgccaccaacggtgcaattagccgatactatgtccagaatggagtcaagttccagcagcccaacgctcaagtcggcagctactctggcaacaccatcaacgccgactactgtgcagctgagcagacagccttcggcggaacctcattcacagacaagggcggccttgcccagatcaacaaggcattccagggcggaatggtcttggtcatgagcttgtgggatgattacgctgtcaacatgctttggttggattccacctacccagcaaacgccactggcacccccggcgccaagcgaggaagctgctctaccagctctggtgttcccgcccaagtcgaagctcagtcacccaactccaaggttgtcttctccaacatccgcttcggacccattggcagcactggcggcaacactggcagcaaccctcccggcacttcgaccactcgggcgcctccgtccagcactggaagctcccccaccgccacccagacacactacggccaatgtggtggaactggctggggcggacctaccatatgcgctagcggctacacttgccaggttctgaacccattctactctcagtgcctgtaa

SEQ ID NO: 36 - protein, 504 aa, Unknown
  Obtained from environmental sample
  DOMAIN (472)...(500): Fungal cellulose binding domain
  DOMAIN (19)...(444): Glycosyl hydrolase family 7
MYQKLAAISAFLAAARAQQVCTQQAETHPPLTWQKCTASGCTAQSGSVVLDANWRWTHDTKSTTNCYDGNTWSSTLCPDDATCAKNCCLDGANYSGTYGVTTSGDALTIQFVTQSNVGSRLYLMATDTTYQEFTLSGNEFSFDVDVSQLPCGLNGALYFVSMDADGGKSKYPGNAAGAKYGTGYCDSQCPRDLKFINGQANVDGWQPSSNNANTGIGNHGSCCSEMDIWEANSISEALTPHPCEDVGQTMCSGDSCGGTYSDDRYGGTCDPDGCDWNPYRLGNTSFYGPGSSFTLDTTKKLTVVTQFATNGAISRYYVQNGVKFQQPNAQVGSYSGNTINADYCAAEQTAFGGTSFTDKGGLAQINKAFQGGMVLVMSLWDDYAVNMLWLDSTYPANATGTPGAKRGSCSTSSGVPAQVEAQSPNSKVVFSNIRFGPIGSTGGNTGSNPPGTSTTRAPPSSTGSSPTATQTHYGQCGGTGWGGPTICASGYTCQVLNPFYSQCL

SEQ ID NO: 37 - DNA, 1014 bp, Unknown
  Obtained from environmental sample
atgccgaagaagcttctcgcgtcgttcatcgcattattcttcgcggcgaacgcggccgctgcgccttcgtcccaggagccacctgcctcttcgcagctggagcttcgccgcggggtgaacgtcctgggttacgacccgatctggaccgatcccgcaaaaggccgtttccagcagagccactttgccgagattcggcgcggcggcttcgacttcgtacgcgtcaacctccacgccttcggtcacatggacgcgaagaatcagctgaagcccgccttcattgagcgcctcgactggatcgttacgaacgcgacggctgccggtctctcggtcatcctcgatgagcacgacttcaacgcctgtgcggacaatgtggagacgtgtcgaacgaggctgtcggccttctggagccaggtggctccgcgatatcgggacgcaccgccgacggtgcttttcgagcttctgaatgagccgcacgcgaaactggacgcggacacttggaacggcttgtttccggagatccttgcgattgtgcgccagaccaatcccacgcgccgggtcatcatcggaccgacacaatggaacagccgtgagaagctcgacacgctgaagctacccgcgaacgacccgaacatcatcgcgaccttccattattacgacccgttccccttcacccaccaaggtgcgtcgtgggtcgaggagatgaaggcggtgaacggcatcacctggggcagcgagggcgaccgggcgcaggttgcgaccgacttcgacaaggtcgcgcaatgggcgaaggcgaacaatcggcagatactgctaggcgagttcggagcctacgatcggagcgggacgccgaccgcgatgcgcgcagcctacacggaggcggtcgcccgcgaggccgagcggcacggcttctcctgggcctattggcagttcgacagcgacttcatcgtctgggacatggccaggaagggctgggtcgagcccatccacaaggcgctgatcccggaggctcgctag

SEQ ID NO: 38 - protein, 337 aa, Unknown
  Obtained from environmental sample
  SIGNAL (1)...(20)
  DOMAIN (38)...(318): Cellulase (glycosyl hydrolase family 5)
MPKKLLASFIALFFAANAAAAPSSQEPPASSQLELRRGVNVLGYDPIWTDPAKGRFQQSHFAEIRRGGFDFVRVNLHAFGHMDAKNQLKPAFIERLDWIVTNATAAGLSVILDEHDFNACADNVETCRTRLSAFWSQVAPRYRDAPPTVLFELLNEPHAKLDADTWNGLFPEILAIVRQTNPTRRVIIGPTQWNSREKLDTLKLPANDPNIIATFHYYDPFPFTHQGASWVEEMKAVNGITWGSEGDRAQVATDFDKVAQWAKANNRQILLGEFGAYDRSGTPTAMRAAYTEAVAREAERHGFSWAYWQFDSDFIVWDMARKGWVEPIHKALIPEAR

SEQ ID NO: 39 - DNA, 1872 bp, Unknown
  Obtained from environmental sample
atgacccagcccgatatccgcgtcgccggtccgctgttcctggatcgtcacggccggcaggtgatcctgcgcggcgtcaacctcggcggcgacaccaaggtcccctggcccggcggcggcaccgagaacccgtccaatttcaccgatcatcgcgccgtttcgttcgtcggacggccatttccgctggaagaggccgatgagcatctggcccgtatcgccggctggggcttcaacgtgctgcggctgctgaccacctgggaggcggtcgagcacgcggggcccaggcagtacgacaccgcctatctcgactatctggtcgcggtcatcggcaaggcggccgagcacggcctcaacgtcttcatcgacttccaccaggacgtctgggcccggatgagcggcggcgacggcgcgcccggctggacgttcgaggcggcaggcctggacatcggccgcttccacgccagcggcgcggcgctggtgatgcagaacgcctacgactacgccagcgacgaacgccgtcagcccgcctatccgcagatggtctggagcagcaactaccggctgccggccaacggggtgatgtggagcctgttctggggcggccggttcttcgcgccggacttcgagatcgagggcgagaacgtccagaacttcctgcaggggcgatacctgggcgccatggacgccatcgcccgccgggtgaaagacctccccaacgtgatcggcttcgacaccctcaacgaacccggcttcggctggttcgggacgccgttgagctatcggcacctgaggaagaccgaggagaaccgcgtcctgccgatggacggcccggccctgtcgcccggcgaccagctggcgatcctggcgggcgagtcgccgagcgtgccggtgctcaagggcggcgaggtggtcggcgagcaggtcatgaaccccggcggggtgcgggtctggacgggcgccgacccgttcgcggcgcacctgcgcgaagacctgttcagccatgccggcggtcacccgctgtcgctgtcggaagacgcctatgggcccttcttccagcgcgtggcggacaccatccgggcgcacaatccgggctgggcggtgttcgccgagatggacccctacgccgtcttcgccaagcgcggctttccgacgacgctgccggagcggacggtcaacgccggccactggtacgacgtgcggctgctgcattcgaaggactacgacgccaaggccgacccggccgagacggcggcccgctacgtgcgccagctgtcgcacctcaagcgcgaggccgaggcgttcgagggcggggctccggccctggtcggggagttcggcatcccctacgacctcgaccaaggcgaggcctacgcggcctgggaccgcggcgagcgggacgggatctgggccaagcacgaggcggcgctgacggcgatgtacgacgcgctggaccagctgcatctgcattcgacgcagtggaactacaccgccagcaaccgcaacgacctgcgcatcggcgaccgctggaaccaggaggatctgtcgatcttctcggccgaccagatcgagcccggcaaccccgacggcggccgggccacggcgggcttctgccggccctacgcccgggcggtgcaggggcggctggtcgaggtggcgttcgacaaggcggcggggacgttccggctggtctgggacgcggacccggccgtgctcgagccgacggagatcttcgtgcccgggctccagttcccgaacggcttcgacctcgacatcgacggcgactgggaagaggcgggcgaggcgggggaccagctgctggtggtgagggcgcggtcggcggggcggatcgcgctgaccttgaagcgcctctga

SEQ ID NO: 40 - protein, 623 aa, Unknown
  Obtained from environmental sample
  DOMAIN (39)...(503): Cellulase (glycosyl hydrolase family 5)
MTQPDIRVAGPLFLDRHGRQVILRGVNLGGDTKVPWPGGGTENPSNFTDHRAVSFVGRPFPLEEADEHLARIAGWGFNVLRLLTTWEAVEHAGPRQYDTAYLDYLVAVIGKAAEHGLNVFIDFHQDVWARMSGGDGAPGWTFEAAGLDIGRFHASGAALVMQNAYDYASDERRQPAYPQMVWSSNYRLPANGVMWSLFWGGRFFAPDFEIEGENVQNFLQGRYLGAMDAIARRVKDLPNVIGFDTLNEPGFGWFGTPLSYRHLRKTEENRVLPMDGPALSPGDQLAILAGESPSVPVLKGGEVVGEQVMNPGGVRVWTGADPFAAHLREDLFSHAGGHPLSLSEDAYGPFFQRVADTIRAHNPGWAVFAEMDPYAVFAKRGFPTTLPERTVNAGHWYDVRLLHSKDYDAKADPAETAARYVRQLSHLKREAEAFEGGAPALVGEFGIPYDLDQGEAYAAWDRGERDGIWAKHEAALTAMYDALDQLHLHSTQWNYTASNRNDLRIGDRWNQEDLSIFSADQIEPGNPDGGRATAGFCRPYARAVQGRLVEVAFDKAAGTFRLVWDADPAVLEPTEIFVPGLQFPNGFDLDIDGDWEEAGEAGDQLLVVRARSAGRIALTLKRL

SEQ ID NO: 41 - DNA, 1380 bp, Unknown
  Obtained from environmental sample
aagctcgccgcccgttttccgggcgatttcgtcttcggcgtcgcgaccgccgccttccagatcgaaggcgcgtcgaaagcagatggccgcaagccctcgatctgggatgccttctccaacatgccgggtcgcgtccataaccgcgacaatggcgatgtcgcctgcgatcattacaaccggctcgacgaagacctcgacctgatcaaggaactgggtgtcgaagcctatcgcttctcgatcgcctggccgcgtatctatcctgatggcactggcccgctgaacgagaagggtctcgatttctacgaccgcctggtcgacggttgcaagcagcgcggcatcaagacctttgcgacgctctatcactgggatctgccgctgaccctgatgggcgacggcggctggacggcgcgctcgaccgcttatgccttccagcgctatgcgcagacgatcgcccggcgcctcggcgaccggctcgacgcggtcgcgaccttcaatgagccctggtgctcggtcatcctgtcgcatcttctcggcatccatgcgcccggcgagcgcaacatgcaggccaccctgcatgcggcccactacaccaatcttgcccacggcctcggcgtcgaggcgatccgggccgaggcgccaaagctgcccgtcggcatcgtctacaacgcgatgtcgatcatcccggccacacagacggaggctgatctggctgccgccaagcgcgccgaggacttccacaatgacatgttctttggccccgtgttcaagggcgcctatcccaaggccctgatcgaagcctacgagccgatcatgcccgtcatcgaggagagcgacctcaagatcatcagccagaagatcgactggtggggcctgaactactatacgccgatgcgcgtggccgccgatcccaatccggatgccccctatccggcgcatatccaggcgccggctgtgaagccggaaaagaccgatatcggctgggaaatcgattccacaggcctcacccatatcgtccgcgacctctattcgaaatatgacctgccggattgctacatcaccgagaatggcgccgcctacaacatggacgtgggcgccgatggcgaagtcgatgaccagccgcgtctcgattattatgtcgaccatctcggagtcacggccgacctgatcaaggaaggcttcccgatgcgcggctattttgcctggtcgctgatggacaatttcgaatgggcggagggctacaagatgcgcttcggcctcgtccatgtcgattacgagacccaggtccgcacagtgaagaagagcggcaagtggtattccgagctggcgagcgaattccccaagggcaatttcgccaacaccaaggccgccgaggccgccgag

SEQ ID NO: 42 - protein, 460 aa, Unknown
  Obtained from environmental sample
  DOMAIN (2)...(447): Glycosyl hydrolase family 1
KLAARFPGDFVFGVATAAFQIEGASKADGRKPSIWDAFSNMPGRVHNRDNGDVACDHYNRLDEDLDLIKELGVEAYRFSIAWPRIYPDGTGPLNEKGLDFYDRLVDGCKQRGIKTFATLYHWDLPLTLMGDGGWTARSTAYAFQRYAQTIARRLGDRLDAVATFNEPWCSVILSHLLGIHAPGERNMQATLHAAHYTNLAHGLGVEAIRAEAPKLPVGIVYNAMSIIPATQTEADLAAAKRAEDFHNDMFFGPVFKGAYPKALIEAYEPIMPVIEESDLKIISQKIDWWGLNYYTPMRVAADPNPDAPYPAHIQAPAVKPEKTDIGWEIDSTGLTHIVRDLYSKYDLPDCYITENGAAYNMDVGADGEVDDQPRLDYYVDHLGVTADLIKEGFPMRGYFAWSLMDNFEWAEGYKMRFGLVHVDYETQVRTVKKSGKWYSELASEFPKGNFANTKAAEAAE

SEQ ID NO: 43 - DNA, 1374 bp, Unknown
  Obtained from environmental sample
atgatgcgatatctttccatcgttgccgccacggcacttctgaccggagtggaagctcagcaatcagtctggggacaatgtggtggtcaaggctacactggcgcgacgtcatgcgctgccggttctacatgcagcactcaaaacccttactacgcacaatgcgtccctgccaccgctacttcaactacattggtgacaaaaacgtcttctaccagcgtcggaacgacatcaccgccaacaacaaccacgacgaaagctagtaccactgctactaacactgccgctgcatccggaaacccattctccggttaccagctctatgccaatccgtactattcttcagaagtacacacccttgccctcccatctttgactggctcacttgccgctgctgcgaccaaagctgccgaggtcccctcatttgtctggcttgacacggcagccaaagtgcctacaatgggcacctacttggccaacattgaagctgcaaacaaggctggcgccagcccacctattgccggtatcttcgttgtctatgacttgcctgaccgtgactgcgcagcagctgcaagtaatggcgaatacactgtagcaaacaacggtgtagcaaactataaggcttacattgatagcattgtggctcagttgaaagcctatcccgacgtgcacacaatccttatcattgagcctgatagtcttgccaacatggtcaccaatttgtctacagccaagtgtgccgaagctcaatctgcatactatgagtgcgtcaactacgcattgatcaacctcaacttggccaacgtagccatgtacatcgatgccggtcatgctggttggctcggatggcctgccaatctttcaccggcggctgaactcttcgcaacagtctataagaatgcaagtgctcctgctgcacttcggggattggctaccaacgttgccaactacaatgcctggtcgatcagcagcccaccctcatacacatctggcgactccaactacgacgaacagctctacatcaacgctttgtctcctctcctgacatctaacggctggcctaacgctcacttcatcatggatacttcccggaacggtgttcaaccgactaaacagcaggcatggggtgactggtgcaacgtgatcggaaccggcttcggtgttcagccgacaacaaatactggtgacccactcgaggatgcctttgtctgggtcaagccaggtggtgaaagtgatggtacatcaaacagttccgctactcgttacgatttccattgcggctacagtgatgcacttcaacctgctcccgaggctggcacttggttccaagcatactttgtccagcttttgaccaatgccaacccagctttggtctag

SEQ ID NO: 44 - protein, 457 aa, Unknown
  Obtained from environmental sample
  SIGNAL (1)...(19)
  DOMAIN (108)...(423): Glycosyl hydrolases family 6
  DOMAIN (23)...(51): Fungal cellulose binding domain
MMRYLSIVAATALLTGVEAQQSVWGQCGGQGYTGATSCAAGSTCSTQNPYYAQCVPATATSTTLVTKTSSTSVGTTSPPTTTTTKASTTATNTAAASGNPFSGYQLYANPYYSSEVHTLALPSLTGSLAAAATKAAEVPSFVWLDTAAKVPTMGTYLANIEAANKAGASPPIAGIFVVYDLPDRDCAAAASNGEYTVANNGVANYKAYIDSIVAQLKAYPDVHTILIIEPDSLANMVTNLSTAKCAEAQSAYYECVNYALINLNLANVAMYIDAGHAGWLGWPANLSPAAELFATVYKNASAPAALRGLATNVANYNAWSISSPPSYTSGDSNYDEQLYINALSPLLTSNGWPNAHFIMDTSRNGVQPTKQQAWGDWCNVIGTGFGVQPTTNTGDPLEDAFVWVKPGGESDGTSNSSATRYDFHCGYSDALQPAPEAGTWFQAYFVQLLTNANPALV

SEQ ID NO: 45 - DNA, 1569 bp, Unknown
  Obtained from environmental sample
atgtccctcctgctcacggcactgtccctcgtcgcggcagccaaggctcagcaagtctgcaccctcacgacggagacacacccacctctgtcgtggtccaaatgcacctcgtcgggctgcaccacgacgcagggctctgttgtcgtcgacgccaactggcgctggactcatctcaccagctcgtcgacaaactgctacacgggcaacaaatgggacacgtccatctgcacgtcgggggccacgtgcgcggcgcaatgctgcgtcgacggcgccgactatgccggcacgtacggcgtcacaacgtcgggcaaccagctcaacatcaagtttgtcaccaacgggccctacagcaagaacattggcagtcggctgtacctgatgcaggacgacaccaactaccagatgttcacgctgctgggcaacgagttcagcttcgacgttgacgtgtccaagattagctgtgggcttaacggcgccctgtactttgtgtcgatggaccaggacggcggcatgtccaagtacagcggcaacaaggccggtgccaagtacggcacgggatactgcgacagccagtgcccgcgagacgtcaagtttatcaatggcgtggccaactcggacggttggcagccatcggccaacgacgccaacgctggcatcggcaacctgggcacctgctgcgccgaaatggacatctgggaagccaacgacatctcggccgcctacaccccccatccgtgcaccaccatcggccagcactcgtgcactggcgacagctgcggcggcacctactcctcggaccgatacggcggcgattgcgaccccgacggctgcgacttcaacagctaccgccagggcaacaccaccttctacggccccggctccggcttcaccctcgacaccacccagaagctcaccgtcgtcacccagttcctcaagggctccgacggcaacctctccgagattaagcgcttctacgtccagaacggcaaggtcgtccccaactcccagagcgacatctctggcgtctcgggcaactcggtcacccaggcctactgcgacgcccaaaagtccgtctttggcgacaaggactcgttcaatgcaaagggcggcttggcacagatgggcaaggcggtcgctcagcccatggttctggtcatgagcctctgggacgaccactactccaacatgctctggctcgactctacctatcccacaaactccaccgctctgggcaccaaacgcggcagctgtgccaccacctctggcgtcccctccgacattgagaactcagcggccgactctaccgtcgtcttctccaacatcaagttcggcgccatcaactccacctttactggctctgggaacacgggcggcggtagcaccaccaccaaagccagcagcaccaccaccagcatcaagaccagcaccagctccagctctggcagcactgccacgggaaccgctcctcactggggtcagtgtggtggcatcggctggactggtcctaccgtctgcgctgccggatatacttgcacttacaacaatgcctactactctcagtgcttgtaa

SEQ ID NO: 46 - protein, 522 aa, Unknown
  Obtained from environmental sample
  DOMAIN (18)...(452): Glycosyl hydrolase family 7
  DOMAIN (490)...(518): Fungal cellulose binding domain
MSLLLTALSLVAAAKAQQVCTLTTETHPPLSWSKCTSSGCTTTQGSVVVDANWRWTHLTSSSTNCYTGNKWDTSICTSGATCAAQCCVDGADYAGTYGVTTSGNQLNIKFVTNGPYSKNIGSRLYLMQDDTNYQMFTLLGNEFSFDVDVSKISCGLNGALYFVSMDQDGGMSKYSGNKAGAKYGTGYCDSQCPRDVKFINGVANSDGWQPSANDANAGIGNLGTCCAEMDIWEANDISAAYTPHPCTTIGQHSCTGDSCGGTYSSDRYGGDCDPDGCDFNSYRQGNTTFYGPGSGFTLDTTQKLTVVTQFLKGSDGNLSEIKRFYVQNGKVVPNSQSDISGVSGNSVTQAYCDAQKSVFGDKDSFNAKGGLAQMGKAVAQPMVLVMSLWDDHYSNMLWLDSTYPTNSTALGTKRGSCATTSGVPSDIENSAADSTVVFSNIKFGAINSTFTGSGNTGGGSTTTKASSTTTSIKTSTSSSSGSTATGTAPHWGQCGGIGWTGPTVCAAGYTCTYNNAYYSQCL

SEQ ID NO: 47 - DNA, 1170 bp, Unknown
  Obtained from environmental sample
atgagaaaaaacattttaatgttagccgtagctatgattgcggcaatgtgtttaactacgtcgtgcggaaacaaagcccagaaacaggacgaaacgcaggctggacaagtgaacaacttccgcattaagcgcggtaccaacatcagtcattggctgtcgcagagtgagcagcgtggcgaggcccgtcgcttgcacattcaggaggacgactttgcacgtctggaggagttaggattcgactttgtacgtattcccatcgacgaggtacagttctgggacgaggacggcaagcagttgcccgaggcttggggattgctgaacaacgcactcgactgggcaaagaagcacaacctgcgcgccattgtggatctgcatattatccgctcgcactactttaacgcagcaaacgaggacgataaggctgctaacaccctgtttacatcagaagagtcgcagcagggactgattaacctgtggaagcagctgtcggacaccttaaagaaccgcagcaacgactgggtggcttacgagtttatgaacgagcctgtagcacccgagcacgagcagtggaaccagctggtagccaaggtacacaaggccctgcgcgaactggagccacagcgtacactggtaattggtagtaacatgtggcagggacacgagaccatgaagtacctgaaggtgcccgagggcgacaagaatatcatcctgagtttccactactacaaccccatgattctgacacactatggtgcttggtggacaccactgggcaagtatcagggcaaggtgaactatcctggtgtgctggtatcgaaggaggattacgaggctgctcctgcagagatcaaggatcagctgaagccttacaccgagcaggtatgggatatcaacaccatccgtgcacagtttaaggatgccatcgaggctgccaagaagtacgacctgcagctgttctgcggtgagtggggtgtttacgagccagtggaccgtgagttggcttacaactggacacgcgatatgctgaccgtattcgacgagtataacattgcctggacaacctggtgctacgatgccgactttggtttctgggatcagcagcgccacaccttcaaggaccgtccattggttgagttgctgatgagtggcaaaaaactgggagacgaatga

SEQ ID NO: 48 - protein, 389 aa, Unknown
  Obtained from environmental sample
  SIGNAL (1)...(28)
  DOMAIN (49)...(365): Cellulase (glycosyl hydrolase family 5)
MRKNILMLAVAMIAAMCLTTSCGNKAQKQDETQAGQVNNFRIKRGTNISHWLSQSEQRGEARRLHIQEDDFARLEELGFDFVRIPIDEVQFWDEDGKQLPEAWGLLNNALDWAKKHNLRAIVDLHIIRSHYFNAANEDDKAANTLFTSEESQQGLINLWKQLSDTLKNRSNDWVAYEFMNEPVAPEHEQWNQLVAKVHKALRELEPQRTLVIGSNMWQGHETMKYLKVPEGDKNIILSFHYYNPMILTHYGAWWTPLGKYQGKVNYPGVLVSKEDYEAAPAEIKDQLKPYTEQVWDINTIRAQFKDAIEAAKKYDLQLFCGEWGVYEPVDRELAYNWTRDMLTVFDEYNIAWTTWCYDADFGFWDQQRHTFKDRPLVELLMSGKKLGDE

SEQ ID NO: 49 - DNA, 2325 bp, Unknown
  Obtained from environmental sample
atgaaaacgacaaaagctgttactttactggcaatgggcggcgcactctttgcgcttacagcctgcaacggacagaaatggacggaaaggcaagtggattctttcatgctggtcacacaaaagggtggccctacattgggctattcgccgcagtcgggcgttaaaatactgaccgaagacgggtatgcctttaaggacctgaaccgtaatgactcgctggatgactacgaagactggcgactaacggcacaggaacgggccgcagacctggcaaagaaactctcggtggaggagattgccggactgatgctctacagcagtcatcagtcggtgccgatggtttcgcacatgggtttcggggaatccacttacggcgggaagtcgtttaaggaaagcggagccaaaccttccgacctctccgacgaccagaagaaattcctgcgcgacgatcatctgcgggccgtcctgatgacgggcgtggagagtcctgaggtggctgcccgctggaacaacaatatgcaggcctacgtggaagcactcgaccacggcattccggccaacaccagttccgacccgcgccatgaagccaaggccacgaccgaatataatgccggagcgggcgggcaaatctcactctggcctacttcgctcggactggctgccacgttcaatccgcaattagtttatcgtttcggcgagatagcatccgaggaatatcgcgcgctgggcattgccactgccctttcgccgcaggtggacatcgccacggatccccgctggacgcgtttcaacggcactttcggagaagaccctcaactggccacggatatggcgcaggcttactgcgatgcgttccagacaactcccgaaaccaaaggatggggcacgaagagcgtcaatgcaatggtgaagcattggtatggatacggggctcaggagggaggtcgcgactcccatcttgcctccggaaaatatgccgtatatccaggcaagaacctggctatgcataaacgttcgttcacggagggcgctttccggctgaaaggcggcacggagatggcttcggccgtgatgcccatctatagcattctctggaatcaagacccgtcggacgagaacgtgggcggcagctatagccgctggctcattcagcaacaactccgcgacgaagcaaagtttgagggagtggtctgcaccgactggggcatcacgaaggacatgaaggtgcttgacagtccgagaggcggcaagccctggggcgcggaatcgctcaccgagaccgagcgccactacaagattcttcaggcgggcgtggatcagtttggcggcaacaacgagattggtcctgtgctcgaggcctacaagatgtgggctaaggctcaaggcgaggccagcgcccgcgagcgtttcgaacagtctgcacgccgactgctgctcaatgttttccgcgtgggactgtttgagaatccatatttagaccctgccgagtcgcagaagaccgtgggtaatcctgaatttatgaaagcgggctacgaagctcagctgaaatctatcgtgatgctgaagaaccacgccaaccagacgcttcccgtgaaagagaagaaggtgtatgttcccaagcgccacttccccgccatcccaggtctctggggaggcatctcggaggaaaagacggtggagcccatcgacctcgccttggtgggaaagtatttcgaagtggtgaaagaaccgggagaagccgactttgccatctgtctgatagaagaacccagcgccggtttcggctatagcacggctgacgtgaagagcggcggcaatggttacgtaccctatagcctgcaatacgacgactatacggccgaccatgcccgcagtgtgagcattgccggcggcgaccccatggagaaattcaccaaccggagtttcaagggcaaaacggtaaagacctacaaccgcgatgacatgctgctggtgaggaacacgaaaaaggagatgggcgaaaagcccgtcattgtcgttttggagactggccgcccggtggtgcttttagaaatagaaccctttgccgatgctattctggtgtccttcaacgtgcagcatcaggcattgctcgacatcatcagcggaaaggcagaaccttcagccttgttgcccatgcagatgcctgccgacatgaagacggtggaagagcaactggaggacatgccgcgcgacatgcgctgctatcatgatgccgacgggcacacctacgacttcgctttcggcatgaactggcagggagtgatcagcgatgagcgagttatgaaatatggggaaaagccctaa

SEQ ID NO: 50 - protein, 774 aa, Unknown
  Obtained from environmental sample
  DOMAIN (176)...(443): Glycosyl hydrolase family 3 N terminal domain
  DOMAIN (518)...(760): Glycosyl hydrolase family 3 C terminal domain
MKTTKAVTLLAMGGALFALTACNGQKWTERQVDSFMLVTQKGGPTLGYSPQSGVKILTEDGYAFKDLNRNDSLDDYEDWRLTAQERAADLAKKLSVEEIAGLMLYSSHQSVPMVSHMGFGESTYGGKSFKESGAKPSDLSDDQKKFLRDDHLRAVLMTGVESPEVAARWNNNMQAYVEALDHGIPANTSSDPRHEAKATTEYNAGAGGQISLWPTSLGLAATFNPQLVYRFGEIASEEYRALGIATALSPQVDIATDPRWTRFNGTFGEDPQLATDMAQAYCDAFQTTPETKGWGTKSVNAMVKHWYGYGAQEGGRDSHLASGKYAVYPGKNLAMHKRSFTEGAFRLKGGTEMASAVMPIYSILWNQDPSDENVGGSYSRWLIQQQLRDEAKFEGVVCTDWGITKDMKVLDSPRGGKPWGAESLTETERHYKILQAGVDQFGGNNEIGPVLEAYKMWAKAQGEASARERFEQSARRLLLNVFRVGLFENPYLDPAESQKTVGNPEFMKAGYEAQLKSIVMLKNHANQTLPVKEKKVYVPKRHFPAIPGLWGGISEEKTVEPIDLALVGKYFEVVKEPGEADFAICLIEEPSAGFGYSTADVKSGGNGYVPYSLQYDDYTADHARSVSIAGGDPMEKFTNRSFKGKTVKTYNRDDMLLVRNTKKEMGEKPVIVVLETGRPVVLLEIEPFADAILVSFNVQHQALLDIISGKAEPSALLPMQMPADMKTVEEQLEDMPRDMRCYHDADGHTYDFAFGMNWQGVISDERVMKYGEKP

SEQ ID NO: 51 - DNA, 1638 bp, Unknown
  Obtained from environmental sample
atgaagggttccatctcctaccagatctacaagggggctctcctcctctcctccctgctggcctccgtctcggcccagggcgccggcactctgactgccgagtcccacccggccttgacctggcagaagtgctctgccggtggcagctgcacccccgtcagcggtagtgtcgtcattgacgccaactggcgctgggttcacgacaagaacggcaagaactgctacactggtaacacctgggacgcgaccctgtgtcccgatgacaagacctgcgccgccaactgtgccgtcgacggtgccagctacgcgagcacctacggtgtgaccaccagtggcaactctctgcgcatcaactttgtcacccaagcttcccagaagaacatcggttctcgtctctacctgctggagaacgacaccacttaccagaagttcaacctcctgaaccaggagttcacctttgacgtggatgtttccaacctgccctgcggtctcaacggtgccctctacttcgtcgacatggacgccgatggtggtatggccaagtacccaaccaacaaggccggtgccaagtacggtactggatactgtgactctcagtgcccccgtgacctcaagttcatcaacggtatcgccaacgtcgagggctggactccctcctccaacgaccccaactcgggtgtcggtggccacggtacttgctgtgccgagatggacatttgggaggccaactccatctccgaggccctcactcctcacccttgcgacacccccggccagaccatgtgcgagggcaacgcctgcggtggtacctacagcaacgaccgttacgctggtacttgcgatcctgatgggtgtgacttcaacccgtaccgtcagggtgtgaccaacttctacggtcccggcatgaccgtggacaccaagtctcccttcaccgtggtgacccagttcctcaccgacgacggtacctccaccggtaccctgagcgagatcaagcgcttctacgtccagaacggcaaggtgatcggccagccccagtccaccgtcgccggtgtcagcggtaactccatcaccgactccttctgcaaggcccagaaggccgcctttggcgataccgatgacttcaccaagcacggtgccctggccggtatgggtgccgcctttgaggagggcatggtcctggtcatgagtctctgggatgaccacaactccaacatgctctggctcgacagcacctaccccaccaccgccagctccaccaccctcggtgccaagcgcggctcttgcgacatctcctccggtgctcccaacgacgttgagtcccagaatgccaactcctacgttgtcttctccaacatcaaggctggtcccattggctccaccttcaacagcggctccaccggcggcggcaacggcagcggctccaccaccaccaccaagggttccaccaccaccaccaaggccccaaccaccaccaccactaccagcaaggccaccaccaccactgctgcctctggcggtaacggcggcggtgctgctcactgggcccagcgcggtggtgttggctacaccggtcccaccacctgtgccagcccttacacctgcaccaagcagaacgagtactactcccagtgcctgtaa

SEQ ID NO: 52 - protein, 545 aa, Unknown
  Obtained from environmental sample
  SIGNAL (1)...(27)
  DOMAIN (27)...(463): Glycosyl hydrolase family 7
  DOMAIN (513)...(541): Fungal cellulose binding domain
MKGSISYQIYKGALLLSSLLASVSAQGAGTLTAESHPALTWQKCSAGGSCTPVSGSVVIDANWRWVHDKNGKNCYTGNTWDATLCPDDKTCAANCAVDGASYASTYGVTTSGNSLRINFVTQASQKNIGSRLYLLENDTTYQKFNLLNQEFTFDVDVSNLPCGLNGALYFVDMDADGGMAKYPTNKAGAKYGTGYCDSQCPRDLKFINGIANVEGWTPSSNDPNSGVGGHGTCCAEMDIWEANSISEALTPHPCDTPGQTMCEGNACGGTYSNDRYAGTCDPDGCDFNPYRQGVTNFYGPGMTVDTKSPFTVVTQFLTDDGTSTGTLSEIKRFYVQNGKVIGQPQSTVAGVSGNSITDSFCKAQKAAFGDTDDFTKHGALAGMGAAFEEGMVLVMSLWDDHNSNMLWLDSTYPTTASSTTLGAKRGSCDISSGAPNDVESQNANSYVVFSNIKAGPIGSTFNSGSTGGGNGSGSTTTTKGSTTTTKAPTTTTTTSKATTTTAASGGNGGGAAHWAQRGGVGYTGPTTCASPYTCTKQNEYYSQCL

SEQ ID NO: 53 - DNA, 1590 bp, Unknown
  Obtained from environmental sample
atgtctgccttgaactctttcaatatgtacaagagcgccctcatcttgggctccttgctggcaacagctggtgctcagcaaattggtacttataccgctgaaacccatccctctttgagctggtctacttgcaaatcgggtggtagctgcaccacaaactccggtgccattacgttggatgccaactggcgttgggtccatggtgtcaataccagcaccaactgctacactggcaacacttggaataccgccatctgcgacactgatgcatcctgtgcccaggactgtgctcttgatggtgctgactactctggcacgtacggtatcactacctccggcaactcattgcgcctgaacttcgttaccggttccaacgtcggatctcgtacctacctgatggccgataacacccactaccaaatcttcgacttgttgaaccaggagttcactttcaccgtcgatgtctcccacctcccttgcggtttgaacggtgccctctacttcgtgaccatggacgccgacggtggcgtctccaagtaccccaacaacaaggccggcgctcagtacggtgttggatactgtgactctcaatgccctcgtgacttgaaattcatcgctggtcaggccaacgttgagggctggacgccctcctccaacaacgccaacactggacttggcaaccacggagcttgctgcgcagagcttgatatctgggaggcaaacagcatctcagaggctttgactcctcacccttgcgatacacccggtctatctgtttgcactactgatgcctgcggtggtacctacagctccgatcgttacgccggtacctgcgaccctgatggatgtgacttcaacccttaccgtcttggtgtcactgacttctacggctccggcaagaccgttgacaccaccaaacccatcaccgttgtgactcaattcgtcactgacgacggcacatccaccggcaccctctccgagatcagacgttactacgttcagaacggtgttgtcatcccccagccttcctccaagatctccggagtcagcggaaatgtcatcaactccgacttctgcgatgctgagatctccacctttggcgagactgcctccttcagcaaacacggtggcctggcaaagatgggcgctggtatggaagctggtatggtcttggtcatgagtttgtgggacgactactccgtcaacatgctctggctcgacagcacctaccctacaaacgcgactggtacccccggtgccgctcgtggttcctgccctaccacttctggggaccctaagaccgttgaatcacaatccggcagctcctatgtcaccttttctgacatccgggttggtcctttcaactctacgttcagcggtggttctagcaccggtggcagctccactactaccgccagcggcaccaccaccaccaaggcctcttccacctctacttccagcacctctaccggcactggagtcgctgctcactggggtcagtgtggtggccagggttggactggtcctaccacctgcgctagtggaaccacatgcaccgtcgtgaacccttactactctcaatgtttgtag

SEQ ID NO: 54 - protein, 529 aa, Unknown
  Obtained from environmental sample
  DOMAIN (27)...(460): Glycosyl hydrolase family 7
  DOMAIN (497)...(525): Fungal cellulose binding domain
MSALNSFNMYKSALILGSLLATAGAQQIGTYTAETHPSLSWSTCKSGGSCTTNSGAITLDANWRWVHGVNTSTNCYTGNTWNTAICDTDASCAQDCALDGADYSGTYGITTSGNSLRLNFVTGSNVGSRTYLMADNTHYQIFDLLNQEFTFTVDVSHLPCGLNGALYFVTMDADGGVSKYPNNKAGAQYGVGYCDSQCPRDLKFIAGQANVEGWTPSSNNANTGLGNHGACCAELDIWEANSISEALTPHPCDTPGLSVCTTDACGGTYSSDRYAGTCDPDGCDFNPYRLGVTDFYGSGKTVDTTKPITVVTQFVTDDGTSTGTLSEIRRYYVQNGVVIPQPSSKISGVSGNVINSDFCDAEISTFGETASFSKHGGLAKMGAGMEAGMVLVMSLWDDYSVNMLWLDSTYPTNATGTPGAARGSCPTTSGDPKTVESQSGSSYVTFSDIRVGPFNSTFSGGSSTGGSSTTTASGTTTTKASSTSTSSTSTGTGVAAHWGQCGGQGWTGPTTCASGTTCTVVNPYYSQCL

SEQ ID NO: 55 - DNA, 1356 bp, Unknown
  Obtained from environmental sample
atgtatcgaactcttgcaattgcctcctccattctcgccgtggcccaaggccagctggctggcacccagacgaccgaaacccatcctggtatgacatggcagcaatgcactgccaagggtagctgcactaccaagaatggcaagattgtgctggactccaattggcgctggcttcacacaaagacgggatacaccaattgttacaccgacaacaaatgggactcgtccatttgcgccgacaacaaggcttgcgcaacggcctgcgcgctcgatggcgcagattacaagggcacctacggaatccaggctagcggaaactccctgaagttgaccttcgtcactaagggatcgtattccaccaacattggctcccgtacttatatgatgaaggacgactccacatacgagatgttcaagttcaacaaccaagagtttacgtttgatgttgacctttctaaccttccatgcggcttgaacggcgctctatactttgtgtccatggacgccgacggcggcatgaagaagtactcgaccaacaaggctggcgccaagtacggtactggttactgcgatgctcagtgcccacgtgatctcaagtttatcaatggcgagggtaacatagagaattggcagccatcttccaacgacgccaatgctggcgtcggtgggcacggctcatgctgtgccgagatggacatctgggaggccaactccgtctctgccgcctatactccccactcttgctccaccatcgagcaaagccgatgcgatggcgattcctgcggtggaacatactccgccgagcgttatgcaggcgtgtgcgatcccgatggctgcgatttcaactcgtaccgtatgggcgacaagaccttttacggcaagggcaagaccgtcgacacgagcaagaaattcacggtcgttacccagttcatcggtagcggtgccaatatggagatcaagcgcttctacgttcaaaacggcaaggtcattcccaattcgatgtctcaaattcctggtgtcgagggcaattccatcactaccaagttttgcgatcagcagaaggaagtatttggagacaggtacaccttcaaggaaaagggcggcatggcgggcatggcatcggctctgtctaaaggcatggtcttggtcatgtcgctgtgggatgaccataactccaacatgctctggctcgactccaccttccccaccgacaaggacccaagcgttcccggtattggccgtggagaatgcgacatcacatctggcgtgcctgccgatgtcgagtccaagtctgcttcggcttccgtgacctactccaacattcgctacggtcccatcaactccacctttggttag

SEQ ID NO: 56 - protein, 451 aa, Unknown
  Obtained from environmental sample
  SIGNAL (1)...(20)
  DOMAIN (19)...(451): Glycosyl hydrolase family 7
MYRTLAIASSILAVAQGQLAGTQTTETHPGMTWQQCTAKGSCTTKNGKIVLDSNWRWLHTKTGYTNCYTDNKWDSSICADNKACATACALDGADYKGTYGIQASGNSLKLTFVTKGSYSTNIGSRTYMMKDDSTYEMFKFNNQEFTFDVDLSNLPCGLNGALYFVSMDADGGMKKYSTNKAGAKYGTGYCDAQCPRDLKFINGEGNIENWQPSSNDANAGVGGHGSCCAEMDIWEANSVSAAYTPHSCSTIEQSRCDGDSCGGTYSAERYAGVCDPDGCDFNSYRMGDKTFYGKGKTVDTSKKFTVVTQFIGSGANMEIKRFYVQNGKVIPNSMSQIPGVEGNSITTKFCDQQKEVFGDRYTFKEKGGMAGMASALSKGMVLVMSLWDDHNSNMLWLDSTFPTDKDPSVPGIGRGECDITSGVPADVESKSASASVTYSNIRYGPINSTFG

SEQ ID NO: 57 - DNA, 1977 bp, Unknown
  Obtained from environmental sample
atgacaaccagggtcgggcgttgcgcccaagctaagcttctgctcggcttttgcgccttggcgctggcctcctgccagacggcgacgaccggcaccgttccggtcgtccccgtcggtccggtcacgcatgtcgccgccagcgatacgctcaatgagcgggtccggtcgatcgtcgcaagcatgacgctggaacagaagatcgggcaaatgacgcagccggatattcggtccgtcacgcccgacgacgttcggcgttactatatcgggtccatcctcaacggcggcggggcatggccgggcatgaacatgcatgccacggtggaggattggctcaagctgtcggactcattctaccgggcgtcgatggcgacggacatggcggtcaagatccccgttatctggggcaccgacgcggttcacggccacaacaatgtctatggcgcaacgctgtttccgcacaatgtcggtctaggcgccgcgcacgaccccgagctcatggtccggatcggccgcgcgaccgccgagcaggtgcgcgcgaccggcataacctgggccttcgcaccgacgcttgcggtcgtccagaacccgcgttggggccgcagctacgaaagctacagctccgatccgcaactggtgcgcgcctatggcgaagccatggtccgcgggctccagggccagcttgggagcccgacgtccgtgcttgcgaccgcgaagcattggatcggcgacggcggcaccttccacggcaaggatcagggcgaaacccgcaccagcgaagatgaactgctgacggtccagggcgcgggttatgccggggcactggcagccaatgtgcggacggtgatggtcagctactcgagcttcaccgataccgcgaccggcaaggcatggggcaagatgcacggcaacgcgcatctgatcgacggagtgctgaagcaaaagctgggtttcgacggccttgtcgtgagtgactggaacggaatcgagcaagtgccgggctgcaccaaatggcactgcccggaggcagtcaacgccggaatcgacatggtcatggtgccggatgactggaagcagttcatcgcggcgacgctcgacgatgtgcgtgccggccgaatcccgatgagcaggatcgacgacgccgtctcgcgcatcgttagggtcaagcttcaatccgggctgttcgaaagctcgcccgcccgggcccacaccgatgccgctgtgctgcattcgccggccgtcgaggagctcgcgcgggaggcggttcggaaatcgctcgtgctgttgaagaacgagggcggaatcctgccgcttcgcccgaccggaaagatcctggtcgtcggcaagggcgcggacaacctgccgatgcaggccggcggatggtcgctgacctggcagggcgacaatagcgcaaccgccgactatccgaacgccgacactctgctgtccgccttgcgcaagtcgctgggcgccagccgcgtcgactatagcgccgatggatcggcaaaggtcgaaggctatagcgccgtcatcatggtcgccgcggaagacccatatgccgaagggaagggtgacatcgccttcccggcaccgcttcgccacagcgcccgttaccccgccgacctccaggccctgaagcgcatcagcgggagcggcgtcccggtggtgaccttgctgttctcgggccggccgttaccggtcaatgacttgatcaaccggtccgacgcgttcgtggctgcatggctgccaggaaccgaaggcgaagggattgccgacatgctggtcgcgccatcggctcgtcgcgcgccttacgactttgtcggcaggcttccgttcgactggccggcgacagattgcctgggactcggcgacaagccgctatttgcgcgcggttacgggctggcgttgagcgaccgaaggaagttgggacgattgcccgagacccccgtaccggtggcttgcccggccgatagccgctag

SEQ ID NO: 58 - protein, 658 aa, Unknown
  Obtained from environmental sample
  SIGNAL (1)...(30)
  DOMAIN (125)...(352): Glycosyl hydrolase family 3 N terminal domain
  DOMAIN (425)...(637): Glycosyl hydrolase family 3 C terminal domain
MTTRVGRCAQAKLLLGFCALALASCQTATTGTVPVVPVGPVTHVAASDTLNERVRSIVASMTLEQKIGQMTQPDIRSVTPDDVRRYYIGSILNGGGAWPGMNMHATVEDWLKLSDSFYRASMATDMAVKIPVIWGTDAVHGHNNVYGATLFPHNVGLGAAHDPELMVRIGRATAEQVRATGITWAFAPTLAVVQNPRWGRSYESYSSDPQLVRAYGEAMVRGLQGQLGSPTSVLATAKHWIGDGGTFHGKDQGETRTSEDELLTVQGAGYAGALAANVRTVMVSYSSFTDTATGKAWGKMHGNAHLIDGVLKQKLGFDGLVVSDWNGIEQVPGCTKWHCPEAVNAGIDMVMVPDDWKQFIAATLDDVRAGRIPMSRIDDAVSRIVRVKLQSGLFESSPARAHTDAAVLHSPAVEELAREAVRKSLVLLKNEGGILPLRPTGKILVVGKGADNLPMQAGGWSLTWQGDNSATADYPNADTLLSALRKSLGASRVDYSADGSAKVEGYSAVIMVAAEDPYAEGKGDIAFPAPLRHSARYPADLQALKRISGSGVPVVTLLFSGRPLPVNDLINRSDAFVAAWLPGTEGEGIADMLVAPSARRAPYDFVGRLPFDWPATDCLGLGDKPLFARGYGLALSDRRKLGRLPETPVPVACPADSR

SEQ ID NO: 59 - DNA, 1425 bp, Unknown
  Obtained from environmental sample
atggccggacgaacgcttataacactggcctctttggccacgttggcggcttgtgcccctgccgaagcaagacagaactgtgcaacactttggggacaatgtggtggccaaaactggactggtgcaacttgttgtgcctccggcagctcctgtgtagctcagaacccttattattcccagtgtcttcctcagacatccgcaacttctgcgtcttccacaacgcgtgcttcctccaccacttcacaagcaagctcgactaagaccagtgccagtgtaacttccactaccaaggttgccagcaccaccacgactgcccccccagtaggttccggtactgcgacatggagcggcaacccgttttccggagtcaacctttggccaaacaactactatgcttccgaagttagcagcttggcaattccaagcttgactggagccatggccacagccgcagcagcagttgccaaggtgccttcgttcatgtggctagacactttgtccaagacaccccttatggaacagaccctttcagatattcgtgctgcaaacaaggcaggcggtaattacgctgggcagttcgttgtctacgacttgccagatagagactgcgccgccgcggcaagtaacggagagtactcaatcgcaaatggaggcgtagccaactataagaactatattgatactatccgcggcatcgtcactacctactcggacgttcgaattctcctagtcattgaacctgattctcttgccaacctggtgaccaacctaaatgttgccaagtgctccaacgcccaagccgcgtatctggagtgcgtcaactacgccgttacaaagctcaacctccccaatgttgccatgtacctggatgcaggccatgcaggctggctaggctggcccgcaaaccaagaccctgcggctcaactcttcgccaatgtatacaagaacgccggctcgcccagctcgctgcgtggattggccaccaatgtggccaactacaatgcatgggacatatcttcggcgccaccatatacccagggcaacgccgtttacgacgagaagctgtacattcatgccatgggcccgctgctggccaaccatggttggtccaatgcttatttcatcactgatcagggtcgctccggtaagcagcccacgggtcaagcccaatggggtgactggtgcaacgccattggcactggatttggcattcgcccctctgcaaacactggcgacacgctgctcgatgcctttgtgtgggtgaagccgggcggcgagtctgatggcacaagcaatagcagcgccacgcgctacgattatcactgcggacagtcggattccttgcagcctgccccggaagctggtacctggttccaggcttatttcgttcaactcctgaccaacgcgaacccttcgttcatgtaa

SEQ ID NO: 60 - protein, 474 aa, Unknown
  Obtained from environmental sample
  SIGNAL (1)...(23)
  DOMAIN (30)...(58): Fungal cellulose binding domain
  DOMAIN (127)...(440): Glycosyl hydrolases family 6
MAGRTLITLASLATLAACAPAEARQNCATLWGQCGGQNWTGATCCASGSSCVAQNPYYSQCLPQTSATSASSTTRASSTTSQASSTKTSASVTSTTKVASTTTTAPPVGSGTATWSGNPFSGVNLWPNNYYASEVSSLAIPSLTGAMATAAAAVAKVPSFMWLDTLSKTPLMEQTLSDIRAANKAGGNYAGQFVVYDLPDRDCAAAASNGEYSIANGGVANYKNYIDTIRGIVTTYSDVRILLVIEPDSLANLVTNLNVAKCSNAQAAYLECVNYAVTKLNLPNVAMYLDAGHAGWLGWPANQDPAAQLFANVYKNAGSPSSLRGLATNVANYNAWDISSAPPYTQGNAVYDEKLYIHAMGPLLANHGWSNAYFITDQGRSGKQPTGQAQWGDWCNAIGTGFGIRPSANTGDTLLDAFVWVKPGGESDGTSNSSATRYDYHCGQSDSLQPAPEAGTWFQAYFVQLLTNANPSFM

SEQ ID NO: 61 - DNA, 1074 bp, Unknown
  Obtained from environmental sample
atgaataaagaaagattgcgcggagtgaatttgggcggatggttcagtcaggttgactgcatcgaagaaaaggatcctgtcggttttccgggggtcgtaggtcacatcaagacgttccttggaacaagcgatttcaagcgcatccacgatgcggggttcaaccacgttcgcttgccggttgactactttaatttatttaaaggcgacgacctcaagccggacgaagaaatctttgcgctcctggacaaggcgctcaaggacatccaggatgcagatctggacgtgattcttgaccttcacaagtgcccgggtcacgatttccacctcgccagcaaccacgaacaagctttctttgccgatgcgaacgcccgcaaggacacgcgcaagatctgggctttcatggccgaacgctacagctccatgccgcgcgtgatgatggaacttttgaatgaaccggctgcaagcgattccaaggtttgggataaagtcaaggacgaaatcttctgggaaatccgcaagcacgctccgaagaacactatcgtcgtaggcgccaacaagtggaacagcgccagggaattcgaattcttgacaccgctcgatgacgacaacgccatctacagcttccatacctacacgccagtgacgtttacgcaccagggcgccgcatggatcgacgacccgttcttcaagattgaacgcccgtggccaggcgactacgccgcccccgaagcaggcggcacgacacgtttgaatgtggaatatggcaagtgggacaaggcccagttgcaggccagcatccagaacgccctcgatttccgcgccaagtacgacttaccggtaagctgcaacgagttcggcgtttacgtacaagttccccgcaaatatcagcttgcctggatgcgcgacttcctcgacatcctccgcgacgccgacgtgggttacagctactggaactacaagaatctggacttcggccttgtttcgaagggcgaatcgctccacaacagtctagagcagtacaacaaccccgaacgcctcgaccgcgaactcatggaaatgattgctaaggggtaa

SEQ ID NO: 62 - protein, 357 aa, Unknown
  Obtained from environmental sample
  DOMAIN (17)...(327): Cellulase (glycosyl hydrolase family 5)
MNKERLRGVNLGGWFSQVDCIEEKDPVGFPGVVGHIKTFLGTSDFKRIHDAGFNHVRLPVDYFNLFKGDDLKPDEEIFALLDKALKDIQDADLDVILDLHKCPGHDFHLASNHEQAFFADANARKDTRKIWAFMAERYSSMPRVMMELLNEPAASDSKVWDKVKDEIFWEIRKHAPKNTIVVGANKWNSAREFEFLTPLDDDNAIYSFHTYTPVTFTHQGAAWIDDPFFKIERPWPGDYAAPEAGGTTRLNVEYGKWDKAQLQASIQNALDFRAKYDLPVSCNEFGVYVQVPRKYQLAWMRDFLDILRDADVGYSYWNYKNLDFGLVSKGESLHNSLEQYNNPERLDRELMEMIAKG

SEQ ID NO: 63 - DNA, 1191 bp, Unknown
  Obtained from environmental sample
atgaagggtctctacactgccttggtggcttccgccatcagtggcgctctcgctgctcccagccccgttgaacaaggtcccatcactgctcgcgccgctgcggcagcatgcgccactcccgtcactctctccggcaacccgttcgcctcgcgatccatctatgccaacaaggagtactccaaggaggtcatcgccgcggccgcttccatgaccgatagcgccttggctgctaaggcctccaaggtcgcccaggtcggaaccttcctgtggattgacactcgtgcccgtatctcagtcatcgaggacaaccttaaggacgttccttgcaaccagatcgccgccatggtcatctacgatctcccaggccgtgattgtgctgccaaggcttccaacggtgaacttgccgctggtgatatcactacctacaagtccgagtacattgaccccattgtcgccatcttcaagaagtatcccaacactgccattgctctcgtcatcgagcccgattcccttcccaacttggtcaccaatgccgacaagcaggcctgcaaggactccgcctctggatacaaggcgggtgtcgcgtatgctctcaagtcccttaaccttcccaacatcgccatgtacattgatgctggccacggtggctggttgggctggaacgacaacctcaagcccggagccaagatgctcgctagcgtatacaaggacgccggctctcccaagcaagtccgcggcttcgccaccaacgttgccggctggaacgcctgggacctgtcccccggcgagttctccaaggccaccgatgcccagtggaacaagtgccagaatgagaagctctacgtgcaggccttctctcccgagctcaagagcgccggcatgccatcccaggccattgtcgacactggccgtaacgccgtcactggcctccgcaaggagtggggtgactggtgcaacgtcaacggcgccggcttcggtgtccgccccacgagcagcacgggcagctcgctcgttgattctttcgtctgggtcaagcctggtggcgagtctgatggtactagcgatactagcgctacccgctatgactctttctgcggcaaggacgatgcctacaagccttctcccgaggctgggcaatggaaccaggagtactttgagatgctgctcacgaatgctaagccttctttctaa

SEQ ID NO: 64 - protein, 396 aa, Unknown
  Obtained from environmental sample
  SIGNAL (1)...(18)
  DOMAIN (55)...(363): Glycosyl hydrolases family 6
MKGLYTALVASAISGALAAPSPVEQGPITARAAAAACATPVTLSGNPFASRSIYANKEYSKEVIAAAASMTDSALAAKASKVAQVGTFLWIDTRARISVIEDNLKDVPCNQIAAMVIYDLPGRDCAAKASNGELAAGDITTYKSEYIDPIVAIFKKYPNTAIALVIEPDSLPNLVTNADKQACKDSASGYKAGVAYALKSLNLPNIAMYIDAGHGGWLGWNDNLKPGAKMLASVYKDAGSPKQVRGFATNVAGWNAWDLSPGEFSKATDAQWNKCQNEKLYVQAFSPELKSAGMPSQAIVDTGRNAVTGLRKEWGDWCNVNGAGFGVRPTSSTGSSLVDSFVWVKPGGESDGTSDTSATRYDSFCGKDDAYKPSPEAGQWNQEYFEMLLTNAKPSF

SEQ ID NO: 65 - DNA, 1386 bp, Unknown
  Obtained from environmental sample
atggccgtcaaaaacatcttgttggctgctgccgcgctcagcgcctccgtcgccgccaccccgttggagccgcgtcagtcatgcggaggctcttgggcgcaatgcggcggcattggattctcgggcccgacctgctgtgtgtccggaaacacgtgtacgtaccagaacgactggtactcccagtgccttccgggcggaccgaccaccagctcggccgtgcgttccacctcgactacctccaagcagcagggtaccacgtccactgccaccacccacgcatcggccaccactaccgcacccgtgaactcgggcaaccccttcagcggcgtccagatgtgggccaacgactactacgcctctgagatctctgccagcgccatcccctccctcactggcgccatggcgaccaaggccgccgcggttgccaaggttcccaccttccagtggctcgacaccgccgacaaggtaccgacgctgatggcggacacgctctccaagatccgcgcggccaacaagaatgcggccaccccctatgctggattgtttgtggtgtacgatctcccggaccgtgattgcgcggcggcggcgtccaacggcgagtacagcatcgccaatggaggtatcgccaactacaaggcgtacatcgatgccatcaagagccagctcaccacatactcggatgtcaagaacatcctggtcatcgagcccgacagccttgcgaacctcgtgaccaacatgaacgtgaccaagtgcgccaatgcccagtctgcctacctcgagtgcacaaactacgcgctgaagcagctcaacctgcccaacgttgccatgtacctggatgctggacacgccggatggctcggctggagcgccaacctgtcgcccgccgcccagctgtttgcgtcggtctacaagaacgccagcagcccgtctcaggtgcgcggactggccaccaacgtcgccaactacaacgcctggagcctcagctctccaccgtcctacacgtcaggcaactccaactacgacgagaagcactacgtgcaggcgatcgcgccactcctcgcccagcaaggattcaacgcccacttcatcaccgaccagggtcgctccggaaagcagccgacgggccagagccagtggggtgactggtgcaacgctgtgggcaccggattcggcacccgcccgaccaccaacacgggcctcgacgtccaggacgccttcgtttgggtcaagcccggcggtgaatgcgacggcacttccaacaccggcgccgcccgctacgacttccactgcggccagagcgacgctctgcagcccgcgccggaggccggcacgtggttcgagaagtactttgagcagctgctgaccaacgcgaacccggccttttga

SEQ ID NO: 66 - protein, 461 aa, Unknown
  Obtained from environmental sample
  SIGNAL (1)...(18)
  DOMAIN (114)...(428): Glycosyl hydrolases family 6
  DOMAIN (31)...(59): Fungal cellulose binding domain
MAVKNILLAAAALSASVAATPLEPRQSCGGSWAQCGGIGFSGPTCCVSGNTCTYQNDWYSQCLPGGPTTSSAVRSTSTTSKQQGTTSTATTHASATTTAPVNSGNPFSGVQMWANDYYASEISASAIPSLTGAMATKAAAVAKVPTFQWLDTADKVPTLMADTLSKIRAANKNAATPYAGLFVVYDLPDRDCAAAASNGEYSIANGGIANYKAYIDAIKSQLTTYSDVKNILVIEPDSLANLVTNMNVTKCANAQSAYLECTNYALKQLNLPNVAMYLDAGHAGWLGWSANLSPAAQLFASVYKNASSPSQVRGLATNVANYNAWSLSSPPSYTSGNSNYDEKHYVQAIAPLLAQQGFNAHFITDQGRSGKQPTGQSQWGDWCNAVGTGFGTRPTTNTGLDVQDAFVWVKPGGECDGTSNTGAARYDFHCGQSDALQPAPEAGTWFEKYFEQLLTNANPAF

SEQ ID NO: 67 - DNA, 1380 bp, Unknown
  Obtained from environmental sample
atgaagagtgcaacactatttgcccttgcggcgactgcgcaggcccaggtcgcgctctatggacaatgtggcggaatcaattacagtggatccacgacctgtgcttccggttcctactgctcgaagatcaatgactactattcgcaatgtctcccaggctctggaaacggcaatggtgcaacaagcaccacgttgtccactgtagctaggcctacaacctcagcgcggccaaccagtggagccgccaccagttctggatctgcgggaaccagcactgccccatcgaccgaggcctcgggcaatcccttggctggaaagcagttttatgcgaatccgtactacgcttcagagatttcgagtctcgcagttccaacgctttcagcaaagggcagtgcctcgtgggcagccaaggcaaccgacgttgctaaggttggaacctttgtttggctcgacactcgcgccaaggtcgacaccatcgatacatacgcgaaagatgttcaggccaagaacgcagccggtgccaacctcatgctgccgttggtagtctacgaccttcccgaaagagattgcgctgctcttgcctccaacggcgagttgtccctggccaacaacggggccgctctgtaccagggctacattgactctattgccgctaagatcaaggcataccctgacgtcttcttcgtcctcgtcgttgagcccgatagcttggctaacctggtcaccaacctgaatgtgcagaagtgctcgaatgcggcgtctgcttacaagacattgacacaatatgcaatcaagacgctcaacttgaagaacgttgccatgtacctcgatgctgggcacgctgggtggctcgggtggcccgcgaacattgagcctgcggccaagctgtttggtgatctctacaccgctgcaggaaagcctgccgctgtccgaggtctggtcacaaatgtggccaactataacgcttggtcaatttccacgtgcccctcgtatacccaaggatcccagacttgcgatgagaagacatacattaacaatctggctccgctacttcgtgctcagggtttcccggcccacttcatgatggataccagccgcaacggtgtccagcccaccaagcagcaagcgtggggagactggtgcaacgtcattggagctggatttggtatccgcccttccacttccacccccgacccgctccttgatgcctttgcgtgggtgaagccaggaggtgagtgcgatggaacgagcaactccactgccgttcgctacgatgcgcactgtggctacgccgatgctcttcagcctgctcccgaggctggcacctggttccaagcgtactttgagcagctacttgtcaatgccaatcccaagttctag

SEQ ID NO: 68 - protein, 459 aa, Unknown
  Obtained from environmental sample
  SIGNAL (1)...(15)
  DOMAIN (19)...(47): Fungal cellulose binding domain
  DOMAIN (110)...(426): Glycosyl hydrolases family 6
MKSATLFALAATAQAQVALYGQCGGINYSGSTTCASGSYCSKINDYYSQCLPGSGNGNGATSTTLSTVARPTTSARPTSGAATSSGSAGTSTAPSTEASGNPLAGKQFYANPYYASEISSLAVPTLSAKGSASWAAKATDVAKVGTFVWLDTRAKVDTIDTYAKDVQAKNAAGANLMLPLVVYDLPERDCAALASNGELSLANNGAALYQGYIDSIAAKIKAYPDVFFVLVVEPDSLANLVTNLNVQKCSNAASAYKTLTQYAIKTLNLKNVAMYLDAGHAGWLGWPANIEPAAKLFGDLYTAAGKPAAVRGLVTNVANYNAWSISTCPSYTQGSQTCDEKTYINNLAPLLRAQGFPAHFMMDTSRNGVQPTKQQAWGDWCNVIGAGFGIRPSTSTPDPLLDAFAWVKPGGECDGTSNSTAVRYDAHCGYADALQPAPEAGTWFQAYFEQLLVNANPKF

SEQ ID NO: 69 - DNA, 1353 bp, Unknown
  Obtained from environmental sample
atgacgaaatcgaccgaagaatcgaccttccccgaagacttcctctggggcgccgcgacgtccgcgtatcagatcgaaggctcgccactcgcagacggcgccggcccgagcatctggcatcgcttcgtccgcacgcccgggcgcgtgcacaacggcgacaccggcgacgtcgcgtgcgaccactacaaccgctaccgcgaggacgtcgcgctcatgaaggagctcggcctcaacacgtatcgcttcagcatttcctggagccgcatccttcctgagggcaccggccgcgtgaatcagggaggtctcgacttctaccgccggctcgtcgacgagctgctcgcagcgggcatcgcacctaacgcgacgctctaccactgggacctccccgccgcgctcgatgaccgcggcggctggctcaatcgcgacgtcgccgactggttcgccgaatacgcggacgtcatgttccgcgcgctcgacgaccgggtgaagatgtgggcgacgctcaacgagccgtgggtcgtcaccgacggcggctacctgcacggcccgctcgcgcccggacatcgcaacgtctgggaggcgccacgcgcgacgcacaacctgatgcgctcgcacgcgaaggccgtcctcgcctatcgcgccaccggaaagcatcagatcggcacggtcgtgaacctcgagccgaagtacgccgcatccgactcacccgaagacgccgccgccgtcgcacgcgccgacgcgtacatgaaccgccagtacctcgacccgatcctcctcggccgttacccgcaggagctcatcgacggcttcggcgaggcgtggcccgacatcccctcctccgacttcgacgagctcacgacgcccatcgacttcctcggcatcaactactacaagcgcgggatcacgaaggcggacgagtcagtcctcatcgagcgcgccacgcgcgtcgacaaccctcgcggaacgacgacagaagtcggctgggaggtctacgcagacggccttacgaagatcctgacgtgggtccgcgacaactacggcgacctcccgctctacatcaccgagaacggcgcagcgttctacgacccaccggtcgcattcaatggtcgcgtcgaagacccgctgcgcgtcgactacctccgcgaccacatccgcgccgtgcgcgaagccatgaaccagggcgtgaacgtccgcggctactacgtctggtccttcctcgacaacttcgaatgggccctcggctacgccaagcgcttcggcatcgtccacgtggactacgagactctcgtgcgcacgccgaagtcgagcgcgcggtattacgcggacgtgatcaaggcaagacgggcgatctga

SEQ ID NO: 70 - protein, 450 aa, Unknown
  Obtained from environmental sample
  DOMAIN (6)...(449): Glycosyl hydrolase family 1
MTKSTEESTFPEDFLWGAATSAYQIEGSPLADGAGPSIWHRFVRTPGRVHNGDTGDVACDHYNRYREDVALMKELGLNTYRFSISWSRILPEGTGRVNQGGLDFYRRLVDELLAAGIAPNATLYHWDLPAALDDRGGWLNRDVADWFAEYADVMFRALDDRVKMWATLNEPWVVTDGGYLHGPLAPGHRNVWEAPRATHNLMRSHAKAVLAYRATGKHQIGTVVNLEPKYAASDSPEDAAAVARADAYMNRQYLDPILLGRYPQELIDGFGEAWPDIPSSDFDELTTPIDFLGINYYKRGITKADESVLIERATRVDNPRGTTTEVGWEVYADGLTKILTWVRDNYGDLPLYITENGAAFYDPPVAFNGRVEDPLRVDYLRDHIRAVREAMNQGVNVRGYYVWSFLDNFEWALGYAKRFGIVHVDYETLVRTPKSSARYYADVIKARRAI

SEQ ID NO: 71 - DNA, 1371 bp, Unknown
  Obtained from environmental sample
atgaagactgcaactttgttggctcttgcagctactgcacaagcgcaggttgcaacctggggacaatgcggtggtatcaactatagcgggtccacgacctgcgcctctggcaactactgctccaagatcaatgactattattcgcaatgtcttccgggcacgggtggagcaggcaccacgttgtccacagtggccgtacctaccaccggaacttccactaaacctgccacgggagcaccaacatctggatccgcaggtaccacaactgcaccagcatcccaggcctcgggtaatccattggccggcaagacgttttatgcgaatccctactatgcttcggagatttcgagtctggcagttccatcactgtcggcgaaaggcagtgctacttgggcagcaaaagccaccgacgtcgcgaagattggaacttttgtttggcttgatacccgcgccaaggtcccaactatcgcaacatatgcgaaagatgtccaggcacagaatgctgccggagctaatctcatgctgccactggtagtctatgatctccccgaaagagattgcgctgctcttgcctccaatggcgaactgtccctcgcgaacaacggcgccgcgttgtatcagggctacatcgacgacatcgctacccaaatcaaggcgttcccagatgtcttttttgtgctcgtcattgagcccgatagcttggcaaatttggtcacaaacttgaacgtgcaaaagtgctcgaacgcagcatccgcatacaaaactctgacaacatacgcgatcaagacgctcaacttgaagaacgtcgccatgtacatggacgctggtcacgctggatggcttggatggcctgcgaacattaagcctgccgcccagcttttcggtcaactctacagtgatgcaggaaagcccgctgctctccgcggcctggtgaccaacgtggcgaattacaatgcttggtccatttccacctgcccttcatacacgcaaggaagccagacgtgcgatgagaagacttatatcaacaacttggcaccattgcttacagcggagggtttcccagctcacttcatggttgacactagccgtaacggcgttcagccaaccaagcagcaggcgtggggagactggtgcaatgtcattggaactggcttcggtattcgccctaccactgtcactcccgatccactcttggacgcctttgcgtgggtcaagccaggtggcgagtgcgatggaacgagcaactccactgccgttcgctatgatgcacactgcggatacagtgatgctcttcagcctgcacccgaagccggtacctggttcgaggcgtacttcgagcagcttcttgtcaatgccaaccccaagttctag

SEQ ID NO: 72 - protein, 456 aa, Unknown
  Obtained from environmental sample
  SIGNAL (1)...(15)
  DOMAIN (107)...(423): Glycosyl hydrolases family 6
  DOMAIN (19)...(47): Fungal cellulose binding domain
MKTATLLALAATAQAQVATWGQCGGINYSGSTTCASGNYCSKINDYYSQCLPGTGGAGTTLSTVAVPTTGTSTKPATGAPTSGSAGTTTAPASQASGNPLAGKTFYANPYYASEISSLAVPSLSAKGSATWAAKATDVAKIGTFVWLDTRAKVPTIATYAKDVQAQNAAGANLMLPLVVYDLPERDCAALASNGELSLANNGAALYQGYIDDIATQIKAFPDVFFVLVIEPDSLANLVTNLNVQKCSNAASAYKTLTTYAIKTLNLKNVAMYMDAGHAGWLGWPANIKPAAQLFGQLYSDAGKPAALRGLVTNVANYNAWSISTCPSYTQGSQTCDEKTYINNLAPLLTAEGFPAHFMVDTSRNGVQPTKQQAWGDWCNVIGTGFGIRPTTVTPDPLLDAFAWVKPGGECDGTSNSTAVRYDAHCGYSDALQPAPEAGTWFEAYFEQLLVNANPKF

SEQ ID NO: 73 - DNA, 1365 bp, Unknown
  Obtained from environmental sample
atgctttctcgcacactcttcctagcatctctcttgtccacgtccctggtcgctggccagggcgttggctcctaccagaccgagactcatcccaagatgagttggcagcagtgttctggaaccggtggaacgagttgtaagacggtccaaggcgaggtagtagtcgatgccaactggcgctggctacacatcaagggtgactacaagaactgctacgacggcaacacatgggacaaagccacttgtggcacaaacgccaattgcaccaccaactgcgtcgtagagggcgccgactactctggaacatatgggattacggctggaggtaccgatctgacgctcaagttcgtgaccaagggccaatattcgacgaatattggttcgcgtacgtatcttatgaaggactcgagcacttatcagaccttcaacctgatcggtaacgaattcacgtttgacgtcgacgtgagtcaattgccttgcgggctcaatggagccctgtacttcgtcgtcatggaccccaagggccagggcactgctggtgccaagtatgggactggatactgcgatggtcagtgcccacgagacttgaaattcatcaatggaaaggccaatgcggagggctggcaaccttcgtcgaatgacaagaacgccggagtcggagccaggggagcctgctgtgccgagatggatgtctgggaggccaactctatatccactgctctcacccctcattcctgcgatactgttaccttctccgagtgcagcggagacaattgcggtggcacttactcgagcactcgctatgctggaccgtgcgacccgaatggctgcgatttcaacccctaccgcttaggtgtcaccgacttctacggcaagggcaagaccgttgacacaagcaaacccttcactgttgtgactcagttcctgggttctggatcgaccttgtcagagatcaaacgtttctacgtccagggaggcaccgtgattccgaaccctcagccaaagactgctggcatcacgggcaactctatcacccaagaatggtgtgacgctgagaacaaagccaataaagaagacgtgtatccattcaagacgcatggaggaatgaaatctatggcatcagcaatggcgaaaggaatggtattagtaatgtcgctctgggatgaccattatgcaaatatgctttggctggacagcacatatccaaccgaccaaaccggaccagggactgcacgtggagactgccccacgagctcaggcgtgccagcagatgttgaatcgaagaacgcgaacgcccaggtgaagtatggtaacatcaagttcggcccgattggctccacgttcaagcagccgtccgggtcctga

SEQ ID NO: 74 - protein, 454 aa, Unknown
  Obtained from environmental sample
  SIGNAL (1)...(18)
  DOMAIN (21)...(450): Glycosyl hydrolase family 7
MLSRTLFLASLLSTSLVAGQGVGSYQTETHPKMSWQQCSGTGGTSCKTVQGEVVVDANWRWLHIKGDYKNCYDGNTWDKATCGTNANCTTNCVVEGADYSGTYGITAGGTDLTLKFVTKGQYSTNIGSRTYLMKDSSTYQTFNLIGNEFTFDVDVSQLPCGLNGALYFVVMDPKGQGTAGAKYGTGYCDGQCPRDLKFINGKANAEGWQPSSNDKNAGVGARGACCAEMDVWEANSISTALTPHSCDTVTFSECSGDNCGGTYSSTRYAGPCDPNGCDFNPYRLGVTDFYGKGKTVDTSKPFTVVTQFLGSGSTLSEIKRFYVQGGTVIPNPQPKTAGITGNSITQEWCDAENKANKEDVYPFKTHGGMKSMASAMAKGMVLVMSLWDDHYANMLWLDSTYPTDQTGPGTARGDCPTSSGVPADVESKNANAQVKYGNIKFGPIGSTFKQPSGS

SEQ ID NO: 75 - DNA, 1383 bp, Unknown
  Obtained from environmental sample
gtgggatccgttgcgactgatgttgacgccgtgccgggcccgcccgtgccctccgccctgaagctgcctgcatcgttcaagtggggcgtctccaccgctgcctatcagatcgagggggccgtcgcagaggatgggcgaggacccagcatctgggatctgttcggccgacaggccggccgtattgccaatggcgacaccggagatgtcgcatgtgaccactaccatcgctaccgggaagacgtggcgctgatgcggcgcctaggcacgcaggtctaccgcttttcggtggcctggccgcgggtgttgccgcaaggacgcggccaggccaacagcctcggcctcgacttctatgatcgtctgatcgatgaactgctgcgcagcggcatagagccgtggttgtgcctgtaccattgggatctgccgcaggcgttggatgatctcggtggatggcagaatcgcgatatcgctctctggttcgccgactatgccgccctgattgcgcgccgctatggcgaccgggttcggcattttgcgactttcaacgaacccaacgtgtgcacgctgttcggctacggcatgggctggaatgcgcccggtatcgccaaccggcggagtttcctgcaggcggctcaccacgtgaatctcgcgcatggcgaagccgtccgtacattgagagcgttggccccgggagctcttcttggcgccatctacaatcggcagatctgcattccgataagcgcggcgccggaggatgccgtggcggccaatatactggatgcttgctggaaccgactttatgccgacccgcaatgcctcgccgagtatccccccgaactggctgaaagccttctggaattctcgcgggcgggcgatatggcgcggatcgcccagccgatcgactggttcggcctgaaccactactgcccgatctatgcgcgcgccgatcgcggtccgcttggttttgcctgggccgatgcgccggtcgatggccccttgaccggcgtcggctggcgcatcgacccggaagccttccgcaacgaaataatcgcggcgcaccggcgctacaagcttccgatctacgtcacggagaacggctacggagcacacgagacactggatgaagcgggtggggtgaacgacggcgggcgcatcgcctatcttgcaacctatctcagggccctggaggaagccgtcgcttcgggcgccgatgtgcggggttatttcctctggtcgcttctggacaatctcgaatggggtgccggctttgcgagccgttttggaatcgtcttcgtcgactacgcgacccagcggcgtgtgcccaaagcgtcatttgattggtttggcaagttgatccgagcgcagcaggacacccatcacgcgtga

SEQ ID NO: 76 - protein, 460 aa, Unknown
  Obtained from environmental sample
  DOMAIN (18)...(456): Glycosyl hydrolase family 1
MGSVATDVDAVPGPPVPSALKLPASFKWGVSTAAYQIEGAVAEDGRGPSIWDLFGRQAGRIANGDTGDVACDHYHRYREDVALMRRLGTQVYRFSVAWPRVLPQGRGQANSLGLDFYDRLIDELLRSGIEPWLCLYHWDLPQALDDLGGWQNRDIALWFADYAALIARRYGDRVRHFATFNEPNVCTLFGYGMGWNAPGIANRRSFLQAAHHVNLAHGEAVRTLRALAPGALLGAIYNRQICIPISAAPEDAVAANILDACWNRLYADPQCLAEYPPELAESLLEFSRAGDMARIAQPIDWFGLNHYCPIYARADRGPLGFAWADAPVDGPLTGVGWRIDPEAFRNEIIAAHRRYKLPIYVTENGYGAHETLDEAGGVNDGGRIAYLATYLRALEEAVASGADVRGYFLWSLLDNLEWGAGFASRFGIVFVDYATQRRVPKASFDWFGKLIRAQQDTHHA

SEQ ID NO: 77 - DNA, 1362 bp, Unknown
  Obtained from environmental sample
atgtatcaacgcgcacttcttttctccgccttgatggcgggcgtgagtgctcagcaggttggaactcagaagcctgaaacccacccaccactcgcctggaaggagtgtacctcgtctggctgcaccagcaaagatggttccgtggtcattgatgccaactggcgctgggttcactcggtcgatggttacaagaactgctacactggtaacgaatgggacagcaccctgtgccctgacgatgctacctgcgcgaccaactgcgctgtggacggtgcggactatgccggcacctacggagctaccaccgagggagactccctgtccatcaacttcgttaccggatcaaacatcggctcgcgcttctacctcatggaggatgagaacaaataccagatgttcaagctcctgaacaaggaattcaccttcgacgttgatgtttccactcttccctgtggcctcaatggtgccttgtactttgtctccatggatgccgacggtggcatgtccaagtatgagaccaacaaggcgggtgccaagtatggtacaggttactgtgactctcagtgcccgcgtgacctgaagttcatcaacggaaagggtaacgttgaaggctggaagccatctgcgaacgacaagaatgccggtgttggaccacacggttcttgctgtgctgaaatggatatctgggaggctaacagcatctccactgccttgactccccatccctgcgataccaacggccagaccatttgcgaaggtgacagctgcggtggaacctactctaccaccagatacgccggtacctgcgatcccgatggctgcgacttcaaccccttccgcatgggtaacgaatccttctacggccccggaaagatggtggacaccaagtcgaagatgactgtcgtgacccagttcatcaccagcgacggaaccgacactggcagcttgaaggagatcaagcgcgtctatgtccagaatggcaaggtcattgccaactcggcctcggacgtgagcggcattactggcaactcgatcacctcggaattttgcactgctcagaagaagacctttggcgacgaggatgtctttaacaagcatggtggtctgtctggcatgggtgatgctctgggagaaggcatggttctcgtgatgagcctgtgggatgaccacaactctaacatgctctggctcgacggcgagaagtacccaaccgatgctgctgcttccaaggttggcgtcagccgtggcacctgcagcactgactctggcaagccctctactattgaatccgagtctggttctgccaaggtcgttttctccaacatcaaggttggctccattgggtcaaccttttccgcataa

SEQ ID NO: 78 - protein, 453 aa, Unknown
  Obtained from environmental sample
  DOMAIN (19)...(453): Glycosyl hydrolase family 7
MYQRALLFSALMAGVSAQQVGTQKPETHPPLAWKECTSSGCTSKDGSVVIDANWRWVHSVDGYKNCYTGNEWDSTLCPDDATCATNCAVDGADYAGTYGATTEGDSLSINFVTGSNIGSRFYLMEDENKYQMFKLLNKEFTFDVDVSTLPCGLNGALYFVSMDADGGMSKYETNKAGAKYGTGYCDSQCPRDLKFINGKGNVEGWKPSANDKNAGVGPHGSCCAEMDIWEANSISTALTPHPCDTNGQTICEGDSCGGTYSTTRYAGTCDPDGCDFNPFRMGNESFYGPGKMVDTKSKMTVVTQFITSDGTDTGSLKEIKRVYVQNGKVIANSASDVSGITGNSITSEFCTAQKKTFGDEDVFNKHGGLSGMGDALGEGMVLVMSLWDDHNSNMLWLDGEKYPTDAAASKVGVSRGTCSTDSGKPSTIESESGSAKVVFSNIKVGSIGSTFSA

SEQ ID NO: 79 - DNA, 1518 bp, Unknown
  Obtained from environmental sample
atgaacgataactttctttggggtgtttcacaatctggttttcagtttgaaatgggagacaaactgaggagaaatatagataccagaagtgattggtggcattgggttcgtgatccgtggaatattcaaaaggagcttgtaagtggagatctccctgaagaggggataaacaattatgagctttatgaacaggatcatgctttagctaagaatttgggactaaatgcctatagaattggaattgaatggagtaggattttcccctgttctactgtacatatagatgttagttactcccttgattcctatggattaataaaggatattaagataacaaaaaacacactggaggcactggatgaaattgcaaataagagggaagtggagtattacagacgagtaatcatgaatcttaggaataagggattcaaagtcatagtcaacttaaatcatttcacactccctatatggctccatgatccaatagaagcacgagaaagagcattaacaaacaaaaaaataggatgggtgagtgaacattctgtaatagaatttactaagtttgttgcttatattgcatataagtttggagatattgtagatatgtggagtacgtttaatgaacctatggtagttgttgaacttggttatctagcaccctattcgggatttcctcctggagttttgaatccagaggctgcgagattagttatattacatatgataaatgcccatgcgagagcatatgacgctatcaaaaagtttgataagacaaaagctgacaaagactctaaagaaccagctgaagtagggattatctataataacattggtgtttcatacccatataccaacaattcaaaggacatcacagcagctgaaaaaagcaatttctttcacagtgggttatttttaacagcgataaacaaaggaaaacttaacattgaattcgatggggaaacattaatcaatgtaaaacatttaaagagaaatgactggattggattaaactactacacaagagaagttgttagatattctgaaccaaaattcccaagtatctccttaatatcctttgaaggtgttcctgactatggatatgcctgtcaaccaggatcactgtcaaaagatgggaatcctgtaagtgattttggatgggaaatttatcctaaaggcatatacgactcaattgaggctgccagtgaatatgggaaaccaatctatgtaacagaaaatggtattgcagattcaaaagatattttaaggccgtactatattgtttcccatattgcggaaattgagagagcaatagaaaatgggttcgatgttaatggatattttcattgggcattaacagataactatgaatggccaatgggttacagaatgcgttttggtttatatgaagttgatttaataaccaagaaaagaaagccaagagtaaaaagtgttgaaacttacaaagatattattgccaataatggactaaccgaaaagttgcgtgaagaatatctttaa

SEQ ID NO: 80 - protein, 505 aa, Unknown
  Obtained from environmental sample
  DOMAIN (1)...(496): Glycosyl hydrolase family 1
MNDNFLWGVSQSGFQFEMGDKLRRNIDTRSDWWHWVRDPWNIQKELVSGDLPEEGINNYELYEQDHALAKNLGLNAYRIGIEWSRIFPCSTVHIDVSYSLDSYGLIKDIKITKNTLEALDEIANKREVEYYRRVIMNLRNKGFKVIVNLNHFTLPIWLHDPIEARERALTNKKIGWVSEHSVIEFTKFVAYIAYKFGDIVDMWSTFNEPMVVVELGYLAPYSGFPPGVLNPEAARLVILHMINAHARAYDAIKKFDKTKADKDSKEPAEVGIIYNNIGVSYPYTNNSKDITAAEKSNFFHSGLFLTAINKGKLNIEFDGETLINVKHLKRNDWIGLNYYTREVVRYSEPKFPSISLISFEGVPDYGYACQPGSLSKDGNPVSDFGWEIYPKGIYDSIEAASEYGKPIYVTENGIADSKDILRPYYIVSHIAEIERAIENGFDVNGYFHWALTDNYEWPMGYRMRFGLYEVDLITKKRKPRVKSVETYKDIIANNGLTEKLREEYL

SEQ ID NO: 81 - DNA, 1395 bp, Unknown
  Obtained from environmental sample
atgcagagaacatcagcttgggcactgctccttctggcgcagattgccactgctcagcagaccgtctggggacaatgtggtggtatcggctactctggaccgaccagctgtgttgcaggatcttcttgtagcacccagaactcttactacgctcaatgtctcccaggcagtggaaacggcggtggcggtgcggcaaccacgaccacgactgctggacaaaccaccaagaccaccatggccaccaccaccaccacttcaaccaagacctcagctggtagtggcggcagcaccactactgctcctcctgctagcaacagtggcaaccccttcaagggataccagccttacgtgaacccgtactacgcttccgaggttcagagcctggctattccctctctggcagcctctctggcgcccaaggccagcgcggtggccaaggtcccatccttcgtttggctggacactgctgctaaggtccctactatgggcacttacttggcagacatcaaggccaagaacgcggctggtgctaacccacccattgccggtatctttgtcgtttacgatcttcctgaccgtgactgcgctgctcttgccagtaacggcgagtactccatcgccaacggcggtgttgccaactacaagaagtacattgactcgatccgcgctcagcttctcaagtaccctgatgtgcacaccatcctggtcatcgaacccgacagtctcgccaacctggtcaccaacatgaacgtcgccaaatgctcgggtgctcacgacgcctacctggagtgcactgactatgcactcaagcagctcaacttgcccaacgttgccatgtaccttgatgccggacacgctggctggcttggatggcccgccaacattggacccgctgccgacctcttcgccagtgtgtacaagaatgccggctctcccgccgccgtccgtggattggccaccaacgttgccaactacaacgcctggtccatctccacctgcccatcttacactcagggtgaccagaactgtgacgagaagcgctacatcaacgccctcgctcctctcctccgcgcgaacggcttcgacgcccacttcatcatggacacctcccgtaacggtgttcagcccactaagcaacaagcctggggtgactggtgcaacgtcattggcactggcttcggtacccccttcaccaccgacactggtgatgctcttcaggacgctttcatctgggtcaagcccggtggtgagtgtgacggtacctcggacacatcctctcctcgctacgacgcccactgcggatacagcgatgccctcaagccggcccccgaggctggaacttggttccaagcctacttcgagcagctgctcgtcaacgccaacccaagcttctaa

SEQ ID NO: 82 - protein, 464 aa, Unknown
  Obtained from environmental sample
  SIGNAL (1)...(18)
  DOMAIN (117)...(431): Glycosyl hydrolases family 6
  DOMAIN (22)...(50): Fungal cellulose binding domain
MQRTSAWALLLLAQIATAQQTVWGQCGGIGYSGPTSCVAGSSCSTQNSYYAQCLPGSGNGGGGAATTTTTAGQTTKTTMATTTTTSTKTSAGSGGSTTTAPPASNSGNPFKGYQPYVNPYYASEVQSLAIPSLAASLAPKASAVAKVPSFVWLDTAAKVPTMGTYLADIKAKNAAGANPPIAGIFVVYDLPDRDCAALASNGEYSIANGGVANYKKYIDSIRAQLLKYPDVHTILVIEPDSLANLVTNMNVAKCSGAHDAYLECTDYALKQLNLPNVAMYLDAGHAGWLGWPANIGPAADLFASVYKNAGSPAAVRGLATNVANYNAWSISTCPSYTQGDQNCDEKRYINALAPLLRANGFDAHFIMDTSRNGVQPTKQQAWGDWCNVIGTGFGTPFTTDTGDALQDAFIWVKPGGECDGTSDTSSPRYDAHCGYSDALKPAPEAGTWFQAYFEQLLVNANPSF

SEQ ID NO: 83 - DNA, 1365 bp, Unknown
  Obtained from environmental sample
atgtatcgacgcgcagtccttttctccgccctggcggcggcagcccatgctcagcaggttggcacatcgaagcccgagacccatccctctttgacctggcaaaagtgcactgccaagggcagttgcactgaccagaagggttctgttgtcatcgatgccaactggcgctggcttcactctgtcgatgggtacaccaactgctacactggaaacgagtgggatgcgactctctgccctgatgacaagacttgcgccacaaactgtgctctggagggcgctgactacgccgccacctacggtgcgaccaccgatggcaatgccctcactttgagctttgtcactggagccaacgttggctctcgtctgttcttgatggaggacgatagtacctaccagattttcaagctgaagaaccaggagttcacattcgatgtggacacctccgctctgccctgcggactcaatggagctctgtactttgtgtccatggatgccgatggtggcatggctaagtacgatggcaacaaggcaggcgccaagtacggaactggctactgtgactctcagtgccctcgtgatctgaagttcatcaacggccaggccaacgtggacggctgggtgccttccgagaacgacaagaacgccggtgttggcggccacggatcttgctgccctgagatggatatctgggaagccaatagcatttccacggcctacacgcctcacccttgcgagagccccgaacagaccatgtgcgagggcgacaagtgtggcggaacctactcctctactcgctatgcaggaacctgcgatcccgatggatgcgatttcaactccttccgcatgggtaacgagaccttcttcggccctggcaagaccgtcgacaccaagtccaagatgactgttgttactcagttcatcaccagtgacggcaccgatactggcgccctcagcgagatcaagcgcatctacgtgcaggatggaaaggttatcgccaactctgcctcggaagttagcggtgtcaccggaaactctatcacctcggacttctgcacagcccagaagaaagccttcggcgatgaggatgtcttcgcccagaaaggtggtctggctggcatgggcgagggtttggaccagggaatggttttggtcatgagcttgtgggatgaccactatgctaacatgctctggttggacggcgaggtctaccccactgatgcctctgcctccgatcctggtgctgctcgcggtacatgcgccaccacctccggcgacccagcgaccattgagggtgagtcgggctcggccaaggtgacctactccaacatcaaggttggacctattggctctacctacgcttcctaa

SEQ ID NO: 84 - protein, 454 aa, Unknown
  Obtained from environmental sample
  SIGNAL (1)...(17)
  DOMAIN (19)...(454): Glycosyl hydrolase family 7
MYRRAVLFSALAAAAHAQQVGTSKPETHPSLTWQKCTAKGSCTDQKGSVVIDANWRWLHSVDGYTNCYTGNEWDATLCPDDKTCATNCALEGADYAATYGATTDGNALTLSFVTGANVGSRLFLMEDDSTYQIFKLKNQEFTFDVDTSALPCGLNGALYFVSMDADGGMAKYDGNKAGAKYGTGYCDSQCPRDLKFINGQANVDGWVPSENDKNAGVGGHGSCCPEMDIWEANSISTAYTPHPCESPEQTMCEGDKCGGTYSSTRYAGTCDPDGCDFNSFRMGNETFFGPGKTVDTKSKMTVVTQFITSDGTDTGALSEIKRIYVQDGKVIANSASEVSGVTGNSITSDFCTAQKKAFGDEDVFAQKGGLAGMGEGLDQGMVLVMSLWDDHYANMLWLDGEVYPTDASASDPGAARGTCATTSGDPATIEGESGSAKVTYSNIKVGPIGSTYAS

SEQ ID NO: 85 - DNA, 1170 bp, Unknown
  Obtained from environmental sample
atgagaaaaaacattttaatgctggccgtagctatgattgcggcaatgtgcgtaaccacgtcgtgcggaaacaaagcccagaaacaggacgaaacgcaggctggacaagtgaacaacttccgcattaagcgcggtaccaacatcagtcactggctgtcgcagagcgagcagcgtggcgaggcccgtcgcctacacattcaggaggacgactttgcacgtctggaggagttaggattcgactttgtacgtattcccatcgacgaggtacagttctgggacgaggacggcaagcagctgcccgaggcttggggattgctgaacaacgcactcgattgggctaagaagcacaacctgcgcgctattgtggatctgcacattatccgctcacactactttaacgcagcaaacgaggacgataaagctgctaacaccctgtttacttcagaggagtcgcagcagggactgcttaacctgtggaagcagctgtcggacaccttgaagaaccgcagcaacgactgggtggcttacgagtttatgaacgagcctgtagcacccgagcacgagcagtggaacctgctggtagccaaggtacacaaggccctgcgcgaactggagccacagcgtacactggtgattggtagtaacatgtggcagggacacgagaccatgaagtacctgaaggtgcccgagggcgacaagaatatcatcttgagtttccactactacaaccccatgattctgacacactatggtgcttggtggacaccactgggcaagtatcagggcaaggtgaactatcctggtgtgctggtatcgaaggaggattacgaggctgctcctgctgagattaaggatcagctgaagccttacaccgagcaggtttgggacatcaacaccattcgtgcccagtttaaggatgccatcgaggctgccaagaagtacgacctgcagctgttctgcggtgagtggggtgtttacgagccagtggaccgcgagttggcttacaactggacacgcgacatgctgaccgtattcgacgagtacaacattgcctggactacctggtgctacgatgccgactttggtttctgggatcagcagcgccacaccttcaaggaccgtccattggttgagttgctgatgagtggcaaaaaactgggagaggaatga

SEQ ID NO: 86 - protein, 389 aa, Unknown
  Obtained from environmental sample
  SIGNAL (1)...(28)
  DOMAIN (49)...(365): Cellulase (glycosyl hydrolase family 5)
MRKNILMLAVAMIAAMCVTTSCGNKAQKQDETQAGQVNNFRIKRGTNISHWLSQSEQRGEARRLHIQEDDFARLEELGFDFVRIPIDEVQFWDEDGKQLPEAWGLLNNALDWAKKHNLRAIVDLHIIRSHYFNAANEDDKAANTLFTSEESQQGLLNLWKQLSDTLKNRSNDWVAYEFMNEPVAPEHEQWNLLVAKVHKALRELEPQRTLVIGSNMWQGHETMKYLKVPEGDKNIILSFHYYNPMILTHYGAWWTPLGKYQGKVNYPGVLVSKEDYEAAPAEIKDQLKPYTEQVWDINTIRAQFKDAIEAAKKYDLQLFCGEWGVYEPVDRELAYNWTRDMLTVFDEYNIAWTTWCYDADFGFWDQQRHTFKDRPLVELLMSGKKLGEE

SEQ ID NO: 87 - DNA, 1344 bp, Unknown
  Obtained from environmental sample
atgcttccccttgttcttctttccctgctcggcgccgttacggcccagcaggtcggcaccaacgaacctgagacccatccccggatgtcctggaagaagtgcaccggcaacgccaactgccagactgtcaacggcgaggtcgtcattgactccaactggcgctggatccacaaggtcggcggcactgaaaactgctacgaaggcaacaagtggacgggcacctgcaccagcaacagcgactgtgccaacaactgcgccatggagggtgccaactaccccaacacctacggtgtgacgaccagcggcgatgccatgactctcaagtttgtgacgcagcaccagcacggcaccaacgtcggctctcgtctgtacctgatgaactcgcctacccgctacgagatgttcaacctcatcaacaacgagttcacctttgacgttgacctgtccaccgtggcctgtggtctcaacagcgccctctactttgtcgccatggacgccgacggtggcctgggcaagttcccgtccaacaaggccggtgccaagtacggtaccggatactgtgactcgcagtgcgcccgtgacctcaagttcatcggcggtgagggcaactaccagggttgggtcccctcgtccagcgactcccaggctggtattggaaacatgggcgcctgctgcgccgagattgacgtctgggagtccaactcccactcgtacgccctgaccccccacgcgtgctccaacaacaactttcacatctgccgtggcgacgagaactgtggcggcacctactcgcccgaccgcttcaagggcctgtgcgacgccaacggctgcgactacaacccctaccgcctgggccgacaggacttttacggagccggcaagcaggttgacacttccaagaagttcaccgtcgtgacccagttcaccaacaactcgctcaagcagttctttgtccagaacggccgccgcatcgacgtccccacccccggccacagtggccttcccgccagcaacgaggtcaacaagaacttctgcgacaacgtcttccgcgtctttggtgaccgcaaccgctacaacgaggtcggaggctggactgccatgcaggatgccctgcgaaagccccatgtcctggtcatgtccatctgggccgaccactacgccaacatgctctggctcgacggtgtctggccccgcggcggcaaccccgctactcccggcatcaagcgcggtgactgccctgctgaaggcagctccccgcccgaggttattgctaaccaccccaacgctttcgtcacctggtccaacatccgcttcggacccatcggatccaccactggcctgtag

SEQ ID NO: 88 - protein, 447 aa, Unknown
  Obtained from environmental sample
  DOMAIN (17)...(447): Glycosyl hydrolase family 7
MLPLVLLSLLGAVTAQQVGTNEPETHPRMSWKKCTGNANCQTVNGEVVIDSNWRWIHKVGGTENCYEGNKWTGTCTSNSDCANNCAMEGANYPNTYGVTTSGDAMTLKFVTQHQHGTNVGSRLYLMNSPTRYEMFNLINNEFTFDVDLSTVACGLNSALYFVAMDADGGLGKFPSNKAGAKYGTGYCDSQCARDLKFIGGEGNYQGWVPSSSDSQAGIGNMGACCAEIDVWESNSHSYALTPHACSNNNFHICRGDENCGGTYSPDRFKGLCDANGCDYNPYRLGRQDFYGAGKQVDTSKKFTVVTQFTNNSLKQFFVQNGRRIDVPTPGHSGLPASNEVNKNFCDNVFRVFGDRNRYNEVGGWTAMQDALRKPHVLVMSIWADHYANMLWLDGVWPRGGNPATPGIKRGDCPAEGSSPPEVIANHPNAFVTWSNIRFGPIGSTTGL

SEQ ID NO: 89 - DNA, 2238 bp, Unknown
  Obtained from environmental sample
ttgaacaccggctggcgcggaagcttcctcgcagtcgccgcggtttcgctggcggcgctcgcgacttcatctgtggcgcaggcgccgagcgccggcgagcgcgccgaggccgcggtcagcaagatgactgtcgaggagaagctgaagctcgtcttcggctatttcgccagcgactgggagggcaagaagccgcccgctgaagcgcactacgggtcggccggctacgtgccgggaattccgcggctcggcatcccaccgcaatatgagaccgatgccggcgttggagtcgcgacccagggtgccgccaagacgaagcgcgagcgcacgtcgctgccgtcgggaatcgcgaccgcggcgacgtggaacccggagatcgccttccagggcgggcgaatgatcggatctgaggcgcgcgcgtcgggcttcaacgtcatgctcgcggggggcgtcaacctgctgcgcgacccgcgcaacgggcgcaacttcgaatatggcggcgaggacccgctgctcgccggcacgatcgtcggctccgagatcgcgggcatccagtccaaccagatcatctcgaccacgaagcattacgcgctcaacgacctcgagaccggccgcaagggccacgacgtgcgcatcgatccagctgccgcacgcatgtcggacctgctggcattccagctcgcgatcgaacgcggcgatcccggctcggtgatgtgctcgtacaacaaggtgggcggcgacttcgcctgcgagaacgactggcttttgaaccaggtgctgaagggcgactggggcttccgtggctatgtgatgagcgactggggcgcggtgcacagcacggtcaaggcggccgtcaacggcctcgaccagcaatcgggctggccgttcgacgacaagccctatctcggctcgctgctgaagcaggcggtcgcgtcggggcaggtgcccaaatcacggctcgacgacatggctcggcgcgtgctgtacgcgatgttcgcgcacggcgtcgtcgacaatcccgtcaccgaaggcggagcgatcgactatgcggccgacgaggcagtgagccgcgccgacgcagaacaggcgatcgtgctgctcaagaacgaaggcaacctgctcccgctcgatgcgcggcggatcgtcgtcatcggcggccatgccgacaagggcgtgctcgcgggcagcggctcgtcactggtctatccgcgcggcggcaatgcggtcccgggcctaccgccgaccggctggcccggaccggtgatgtatttcccgtcatcgccggtgcaggcgctgcagcggctggtgccgaacgcgagcgtgagcttcgtcgacggcaccgatccgactgcggctgccgccgcggctcaggcggcggacgtcgcgatcgtcttcggcacccaatggtcgagcgagtcgatcgacgtgccgatgaagctcgacggcaaccaggacgcgctgatcgccgccgtcgccgcggcgaacccgcggaccgtcgtcgtgctcgaaaccaatgccggggtgacgatgccctgggccgcgcgcgtgccagccatcgtcgaggcctggtatccgggatcggcggggggcgaggcgatcgccaacgtcctcaccggacgcgtgaacccgtcgggccgcctgccggtgaccttttatgcgtccgaagcgcagcttccgcgcccggcgcgtcccggcaaggatagcgagatggaccagttcgacctgccttacgcggagggtgcagcggtcggctacaaatgggtcgatcgcaacaatctgcagccgctgttcccgttcgggcacggccttgcctacacgacttacgactatgggccgatcagcgtcgctccggagccgaacggcggccttcgggtgcagttcacgctgcggaacacgggcaatcgcccgggcatggccgtcgggcaggtttacgcctcgccggcgagcggcggctgggaggcgcccaggcggctcgtcggcttcgccaaggtcgagctcgcgcccggcgccgcgcagacggtcgccgtcgatgtcgatccgcgcctgctcgccacgttcgacgagccggggcacagctggaacatcgcgcccggcacctacaatctgatgcttggagcctcgtcgcgcgacctgcgcagcaacacgagcgtcacgcttccggcgctcagccttccggcgaactggcggccgggacaggaaggcgctgccccagcgccgcggcccggcgagcgaggccgataa

SEQ ID NO: 90 - protein, 745 aa, Unknown
  Obtained from environmental sample
  DOMAIN (76)...(292): Glycosyl hydrolase family 3 N terminal domain
  DOMAIN (363)...(606): Glycosyl hydrolase family 3 C terminal domain
MNTGWRGSFLAVAAVSLAALATSSVAQAPSAGERAEAAVSKMTVEEKLKLVFGYFASDWEGKKPPAEAHYGSAGYVPGIPRLGIPPQYETDAGVGVATQGAAKTKRERTSLPSGIATAATWNPEIAFQGGRMIGSEARASGFNVMLAGGVNLLRDPRNGRNFEYGGEDPLLAGTIVGSEIAGIQSNQIISTTKHYALNDLETGRKGHDVRIDPAAARMSDLLAFQLAIERGDPGSVMCSYNKVGGDFACENDWLLNQVLKGDWGFRGYVMSDWGAVHSTVKAAVNGLDQQSGWPFDDKPYLGSLLKQAVASGQVPKSRLDDMARRVLYAMFAHGVVDNPVTEGGAIDYAADEAVSRADAEQAIVLLKNEGNLLPLDARRIVVIGGHADKGVLAGSGSSLVYPRGGNAVPGLPPTGWPGPVMYFPSSPVQALQRLVPNASVSFVDGTDPTAAAAAAQAADVAIVFGTQWSSESIDVPMKLDGNQDALIAAVAAANPRTVVVLETNAGVTMPWAARVPAIVEAWYPGSAGGEAIANVLTGRVNPSGRLPVTFYASEAQLPRPARPGKDSEMDQFDLPYAEGAAVGYKWVDRNNLQPLFPFGHGLAYTTYDYGPISVAPEPNGGLRVQFTLRNTGNRPGMAVGQVYASPASGGWEAPRRLVGFAKVELAPGAAQTVAVDVDPRLLATFDEPGHSWNIAPGTYNLMLGASSRDLRSNTSVTLPALSLPANWRPGQEGAAPAPRPGERGR

SEQ ID NO: 91 - DNA, 2637 bp, Unknown
  Obtained from environmental sample
atgactagtggacgaaacacatgtgtgtgtctgttgttgattgtgctggcgatcggtcttctgtcaaagccaccggcgagcgcgcaaaatgaggcgccttataaagccacgctgacgatccggttggaccaaccgggagcggtgatcaatcgcaacatctacggccagtttgcggagcatctcggacgtttgatctacgacgggctctgggttggtgaaggatcgtcgatcccgaacacgcgcggattgcgtaacgacgtcgttacggcgttaaaagaattgcatgtgcctgtgctgcgttggcccggcggctgttttgccgacgagtatcactggcgtgacggcattggaccacgcgacaagcgtccgcggcggccgaacgcgagttggggcggcgtcgattcgaatgcgtttggcacgcatgagttcatggagctgtgcgagatgttgggcgcagacgcttatatcaatggcaacgtcggcagcggcacgccgcaggagatgatggaatggatcgagtacatgacttccgattccgattcggatctcgccaacctgcgccgtcgcaatggccgcgacaagccgtggaaggtgccgtatttcgccgtcggcaatgagacgtggggctgtggtggaaatatgcggccggagttttacgccgacgtgtatcgccagtacgccacgttcatcaagaaccattcaggcaatcgcattcagaaactcgcgagcggtggttacgacaacaattacaactggaccgaggtgctgatggcgcaggcggcgaagcagatcgatggcctgtcgttgcactattacacgctgcccaccggcaactgggacaagaaaggatcggcgacggaattcggcgaaagcgagtggcacgcgacgctcgccaggacgttgcgcatcgaggagttcattcagaagcacagcgcgatcatggacaagcacgatccgcagaagcgcgtcggtttgatggttgacgagtggggcacgtggtacgaccgcgacgagggccgcgacatgggcgcgctttatcagcagaacacgttgcgcgatgcggttgcggccggtatcaatctcaatatctttcacaagtatgccgatcgcgtgcgcatggcgaacatcgcgcagatggtgaacgtgttgcaggcgatggtgttgacggacaaagagaaaatggtgctgacgccgacgtatcacgtttttcggatgtatcgcgtgcatcagggagcgacgctgatcccggtcgaggttagtgcgccgcagtacacgctgggtggtgcgtctgtgccgtcgttgagcgtgtcggcttcgcgtgacggtgaaggacgggtgcatctgtcgatcgtgaatctcgatccagcgcgggcggcggagatcgatgcgaacggaccgttcagcagtgtcaagggagaagtattgactgcgccggcggtgaatgcgctgaatactttcgatcacccggatagtgtcaagcccgtgtcttttaatggatataaattagaaggctctaaattaatcctgaatattccggcgaaatccgtggtggtgttggaacttggaccacagaaacaagcaacgctcaaagatgcattcaaaaacgatttcatgatcggcgcggcgctcaaccggcgacagttcttcgaagaagacgctcgcggcgcagagatcgtgcgcatgcatttcaactcgatcacgccggagaacgtgttgaagtgggggctggtccatcccgaaccgaacaagtacgacttcaccgctcccgatcgcttcgtcgaattcggcgagaagcacggcatgttcgtcgtcggacacacgctcgtctggcataaccaaacgccgcgctgggtttttgaagacgaaaagaaacagccgctcgatcgcgagacgttgctgaaacgaatgcgcgatcacatcttcaccgtcgtcggccgttacaagggacgcattaaaggctgggacgtagtcaacgaggcgctgaatcaggatggcacgatgcggcagtcgccgtggttcaagatcatcggcgaggattatctcgtcaaagcgtttgagtttgcccacgaggccgatccagccgccgagctttattacaacgactacgatctcgagctgccggcgaagcgcgcaggcgccgtcgaactgctgaagaaactgaaagccgcgggtgtgtcgcttgctggtgtgggattgcagaaccacagtctcatggagtggccgtcagccgcagatgtggatgcgacgatcgcggcgttcgcgaatctgggtttgaaggttcacatcacggaactcgacgtcgacgtgctgccgcgcacgacgaaacccggtgcggattacgcagtcgacgtgaaggtgacgccgcagttgaacccgtatctcgacggcttaccggaggcgcgacagtcggcgttggcgaggcgttatgcggagctgtttcacgtgtttagaaaacatcgcgacgcgatcgagcgtgtgacgttctggggagttgcggacggcgattcgtggttgaacaactggcccatccgcggcaggacaaactatccgctgctcttcgatcgttccggccaaccgaaaccggcgttagcgtcggtgatcgaaaccgctaattattcaacggaacgtcgacggtga

SEQ ID NO: 92 - protein, 878 aa, Unknown
  Obtained from environmental sample
  SIGNAL (1)...(28)
  DOMAIN (328)...(515): Alpha-L-arabinofuranosidase C-terminus
  DOMAIN (528)...(870): Glycosyl hydrolase family 10
  SITE (128)...(131): N-glycosylation site. Prosite id = PS00001
  SITE (208)...(211): N-glycosylation site. Prosite id = PS00001
  SITE (235)...(238): N-glycosylation site. Prosite id = PS00001
  SITE (254)...(257): N-glycosylation site. Prosite id = PS00001
  SITE (745)...(748): N-glycosylation site. Prosite id = PS00001
  SITE (768)...(778): Glycosyl hydrolases family 10 active site. Prosite id = PS00591
  SITE (884)...(887): N-glycosylation site. Prosite id = PS00001
MTSGRNTCVCLLLIVLAIGLLSKPPASAQNEAPYKATLTIRLDQPGAVINRNIYGQFAEHLGRLIYDGLWVGEGSSIPNTRGLRNDVVTALKELHVPVLRWPGGCFADEYHWRDGIGPRDKRPRRPNASWGGVDSNAFGTHEFMELCEMLGADAYINGNVGSGTPQEMMEWIEYMTSDSDSDLANLRRRNGRDKPWKVPYFAVGNETWGCGGNMRPEFYADVYRQYATFIKNHSGNRIQKLASGGYDNNYNWTEVLMAQAAKQIDGLSLHYYTLPTGNWDKKGSATEFGESEWHATLARTLRIEEFIQKHSAIMDKHDPQKRVGLMVDEWGTWYDRDEGRDMGALYQQNTLRDAVAAGINLNIFHKYADRVRMANIAQMVNVLQAMVLTDKEKMVLTPTYHVFRMYRVHQGATLIPVEVSAPQYTLGGASVPSLSVSASRDGEGRVHLSIVNLDPARAAEIDANGPFSSVKGEVLTAPAVNALNTFDHPDSVKPVSFNGYKLEGSKLILNIPAKSVVVLELGPQKQATLKDAFKNDFMIGAALNRRQFFEEDARGAEIVRMHFNSITPENVLKWGLVHPEPNKYDFTAPDRFVEFGEKHGMFVVGHTLVWHNQTPRWVFEDEKKQPLDRETLLKRMRDHIFTVVGRYKGRIKGWDVVNEALNQDGTMRQSPWFKIIGEDYLVKAFEFAHEADPAAELYYNDYDLELPAKRAGAVELLKKLKAAGVSLAGVGLQNHSLMEWPSAADVDATIAAFANLGLKVHITELDVDVLPRTTKPGADYAVDVKVTPQLNPYLDGLPEARQSALARRYAELFHVFRKHRDAIERVTFWGVADGDSWLNNWPIRGRTNYPLLFDRSGQPKPALASVIETANYSTERRR

SEQ ID NO: 93 - DNA, 1362 bp, Unknown
  misc_feature: Bacterial DNA
atgcttcagtttccgaaagattttatttggggagctgcaacttcatcgtatcaaattgaaggaacagcgactggagaagataaaatttactcgatctgggatcacttttcccgcattcctggcaaagtagcgaatggggataatggcgatatcgcaattgatcattacaatcgttatgttgaagacatcgcattaatgaaagcgcttcatttgaaagcgtatcgattttcgactagttgggcgagactttattgtgaaacgccagggaagtttaacgaaaaaggtttagatttttataagcgtcttgtacatgaattgctagagaacggtatcgagccaatgttgaccatttatcattgggatatgccacaagctcttcaagagaaaggtggctgggaaaatcgtgatatcgttcactacttccaagaatacgctgctttcctttacgagaatcttggggatgtcgtgaaaaaatggattacgcataatgagccgtgggttgtcacctatttaggatatgggaatggcgaacatgccccagggattcaaaactttacatcatttttaaaagcagcacatcatgttcttctctcacacggggaagcggtaaaagcgtttcgagcaatcggttcgaaagatggggaaattggtattacgttgaatttgacacctggatatgcggtcgatccgaaagatgaaaaagcagttgatgccgctcgaaaatgggacggctttatgaatcgttggtttttagatcctgtatttaagggacaatatccagcagatatgttagaagtgtataaagattatttaccagacgtttacaaagagggagatttacaaacgattcagcaaccgatcgactttttcggatttaactattattcaacagcaacattaaaagattggaaaacaggtgaccgtgaaccgatcgtatttgaacatgtgagcacaggaagacctgtgacggatatgaattgggaagtgaatccaaacggtttgtttgatttaatggtgcgattgaaaaaagattatggcgatattccattatacattaccgaaaacggtgctgcatacaaagatcgcgtcaacgaacaaggtgaagtagaagatgatgagcgagttgcttatatacgggagcatttaatcgcttgccaccgcgcgattgaacaaggcgtcaatttaaaaggatattatgtatggtcgctgttcgataattttgagtgggcatttggatatgataagcgctttgggattgtatacgtggattatgaaacgctagagcgcatcccgaaaaagagtgcattatggtacaaggaaacgattataaacaacggattgcaagtagacaatgacaaataa

SEQ ID NO: 94 - protein, 453 aa, Unknown
  DOMAIN (1)...(453): Bacterial protein
  DOMAIN (1)...(447): Glycosyl hydrolase family 1
  SITE (8)...(22): Glycosyl hydrolases family 1 N-terminal signature. Prosite id = PS00653
  SITE (186)...(189): N-glycosylation site. Prosite id = PS00001
  SITE (355)...(363): Glycosyl hydrolases family 1 active site. Prosite id = PS00572
MLQFPKDFIWGAATSSYQIEGTATGEDKIYSIWDHFSRIPGKVANGDNGDIAIDHYNRYVEDIALMKALHLKAYRFSTSWARLYCETPGKFNEKGLDFYKRLVHELLENGIEPMLTIYHWDMPQALQEKGGWENRDIVHYFQEYAAFLYENLGDVVKKWITHNEPWVVTYLGYGNGEHAPGIQNFTSFLKAAHHVLLSHGEAVKAFRAIGSKDGEIGITLNLTPGYAVDPKDEKAVDAARKWDGFMNRWFLDPVFKGQYPADMLEVYKDYLPDVYKEGDLQTIQQPIDFFGFNYYSTATLKDWKTGDREPIVFEHVSTGRPVTDMNWEVNPNGLFDLMVRLKKDYGDIPLYITENGAAYKDRVNEQGEVEDDERVAYIREHLIACHRAIEQGVNLKGYYVWSLFDNFEWAFGYDKRFGIVYVDYETLERIPKKSALWYKETIINNGLQVDNDK

SEQ ID NO: 95 - DNA, 2163 bp, Unknown
  Obtained from environmental sample
atgaaacatcacaactataacgcgcatcattcgccaatcggcgctttcggctcattcacgctcggttttcgtggtgctcagggcggcctcggactggagttaggcggcccggccaatcacaacatgtacatcggagtggaagacgagcagcgcaccttccattgccttcccttttttggggatgctgctgcaggggccgaggaagcactgcgctacgatgtggaaggcagccaatccagtgacgatccactggccggcgcctatgtcggacacccagaggatgcgccatcgctgcctccggccaagttgcgtgcgctggaccaaagcgccatctcacgggattttcaacttacgaccgacacctggacagcaccggatttctcactcacgatctattcgccggtacgcggcgtgcccgatccgacaacggctgcggaagacgaattgaaagccattcttgtgcccgctgtactctgcgagttgacggtggataactcgagtgggcagcagtctcggcgtgcgctctttggtttcaccgggaacgatccttattggggaacgcggcgccttgatgatgtagcgaatagtgcgttcgtgggggttggcgagggaaatcatctggccattgcgtcacgagatgaaggagtgacggcggcgctgggcttcaacatcaatggcgttatcaacgagactttgcctgagaattacgcctttggtctgggcaaatgcgcagttttgctctgcgaggtgcctgccggtgaaaagcgcacgttccatatcgccgtctgttttcatcggagcggcatcgccaccaccggtttgaagatgcgctattattacacgcgctttttccctgacatcgaaagcgtagccgcttatgcactggagcagttcgattctctcaaaagtgcagctctccaagacaatcaactagtggagaacgcgtcgctttcagaagaccagaaatggatgttctgccacgcggtgcgctcgtactatggctcaacggagttgctggagtataacgacaatccggtgtgggtggtcaacgaaggcgaatatcgtatgatgaacaccttcgacttgacggtggatcatctctactgggaactgcgcctgaatccctgggttgtgaaaaatcagctcgactggtttgtggatcgctactcgtatgaggacaaggtgcgctttcctggtgacaaaactgagtacccatgcggtctctccttcacgcacgatatgggcgtgacgaatgtgtggtcgcgccccggctattcgtcttatgagaagcagggactcaagggtgtcttttcgtatatgacgcacgagcaactcgtcaactggctctgctgcgccacggtgtatgtggaacagaccggtgaccaggagtggcttgaacaacggtggccgattttcaacaggtgctttgagagtttgctcaaccgcgatcaccccgatcctgaaaagcggcgcggcttaatgcaactcgattcgacccgttgcgccggtggtgcggagatcaccacttacgacagccttgatgtctcgctggggcagtcacgcaacaacacctatctgggtgggaaaatctgggcgagctatctggcactcgaaaaattgttccgcgagcgcggcgacgtggaaagagcgcaagtggcgcatcaacaggcgcatcgcacggcgcaaacgctgctggagaatgtcggcgagaatgggacgattcccgccgtactcgaaggcagcaatcagtcgagaatcattcccgtgattgaggggttgatcttcccctacttcaccgggcgcaaggatgtcctcagttccgatggcgacttcggcgagatgttttcggcactcaagcgccatcttgaagccgtgctaaaacccggtatctgtctgtttgaagatggtggctggaagttaagttcaacctctgataactcgtggctgagcaaaatctacctgtgccagttcgtcgcgcgccagatattgggccgtgaacgcgatgacattgacaagcgcgccgatgccgcgcacgtgggctggctgctcgatgagcgcaatgcctacttcgcgtggagtgaccagatgctggccggctttgcggaaggctccaagtactacccgcgcggtgtgaccagcgcattgtggttgctggaaggctga

SEQ ID NO: 96 - protein, 720 aa, Unknown
  Obtained from environmental sample
  DOMAIN (19)...(456): Glycosyl hydrolase family 52
  SITE (167)...(170): N-glycosylation site. Prosite id = PS00001
  SITE (197)...(200): N-glycosylation site. Prosite id = PS00001
  SITE (232)...(235): N-glycosylation site. Prosite id = PS00001
  SITE (318)...(321): N-glycosylation site. Prosite id = PS00001
  SITE (530)...(533): N-glycosylation site. Prosite id = PS00001
  SITE (579)...(582): N-glycosylation site. Prosite id = PS00001
  SITE (590)...(593): N-glycosylation site. Prosite id = PS00001
MKHHNYNAHHSPIGAFGSFTLGFRGAQGGLGLELGGPANHNMYIGVEDEQRTFHCLPFFGDAAAGAEEALRYDVEGSQSSDDPLAGAYVGHPEDAPSLPPAKLRALDQSAISRDFQLTTDTWTAPDFSLTIYSPVRGVPDPTTAAEDELKAILVPAVLCELTVDNSSGQQSRRALFGFTGNDPYWGTRRLDDVANSAFVGVGEGNHLAIASRDEGVTAALGFNINGVINETLPENYAFGLGKCAVLLCEVPAGEKRTFHIAVCFHRSGIATTGLKMRYYYTRFFPDIESVAAYALEQFDSLKSAALQDNQLVENASLSEDQKWMFCHAVRSYYGSTELLEYNDNPVWVVNEGEYRMMNTFDLTVDHLYWELRLNPWVVKNQLDWFVDRYSYEDKVRFPGDKTEYPCGLSFTHDMGVTNVWSRPGYSSYEKQGLKGVFSYMTHEQLVNWLCCATVYVEQTGDQEWLEQRWPIFNRCFESLLNRDHPDPEKRRGLMQLDSTRCAGGAEITTYDSLDVSLGQSRNNTYLGGKIWASYLALEKLFRERGDVERAQVAHQQAHRTAQTLLENVGENGTIPAVLEGSNQSRIIPVIEGLIFPYFTGRKDVLSSDGDFGEMFSALKRHLEAVLKPGICLFEDGGWKLSSTSDNSWLSKIYLCQFVARQILGRERDDIDKRADAAHVGWLLDERNAYFAWSDQMLAGFAEGSKYYPRGVTSALWLLEG

SEQ ID NO: 97 - DNA, 1413 bp, Unknown
  Obtained from an environmental sample
atgcgctatacatggtcggtcgcggcggcgctgctgccatgcgcaatccaggctcagcaaaccctctatggacaatgtggtggtcagggctactccggactcaccagctgcgtggcgggagcaacatgctccaccgtaaatgaatactacgctcagtgtacgccagcagcaggcagcgccacttccaccaccttgaagacaactacgaccaccgctggggcgacgacgacgacgactagcaagacttctgcttcccagacgtctactactaaaacctcaaccagtaccgcctcaacaaccacggctacaaccacggccagcgcgagcggcaacccgttcagtgggtaccagctctacgtgaacccctactactcctccgaagtggcctccctggctatcccatccctcacggggacactttcctcgctccaggctgcagccacagccgcagccaaggtgccctctttcgtctggctggacgtggctgccaaggtgccgacgatggccacctacctggccgacatcaaagcccagaatgcagcgggagccaacccccccgtcgccggccagtttgtggtctacgacctccctgaccgcgactgcgccgcgctggccagcaacggcgagtactccatcgccaacaacggtgtggccaactacaaggcctacatcgactccatccgcaaggtcctggtgcagtactcggatgtgcacaccattctggtgatcgagcccgacagtctcgccaacctggtgaccaacctcaatgtggccaaatgtgccaacgctcagagcgcctacctcgaatgcaccaactatgccctggagcagctgaacctccccaacgtggccatgtatcttgatgccggacacgccggctggctcggctggcccgcgaaccagcaaccggccgccaatctgtacgcgagcgtgtacaagaacgccagctcgcccgccgcagtgcgcggcctggccacgaacgtcgccaactacaacgccttcaccatcgcctcgtgcccgtcgtacacccagggcaacagcgtctgcgacgagcagcagtacatcaacgcgatcgccccgctcctgtcagcgcagggcttcaacgcccacttcatcgtcgacaccggccgcaacggcaaacagcccaccggccaacaagcctggggcgactggtgcaacgtcatcaacacggggttcggcgtgcgcccgaccaccaacacgggcgacgcgctcgtcgacgccttcgtctgggtcaagcccggcggcgagagcgacggcacctccgatagctcggcgacccgctacgacgcccactgcgggtacagcgatgccttgcagccggcgccggaggcggggacctggttccaggcctacttcgtacaattgctctcgaacgccaatccggctttctag

SEQ ID NO: 98 - protein, 470 aa, Unknown
  Obtained from an environmental sample
  SIGNAL (1)...(18)
  DOMAIN (22)...(50): Fungal cellulose binding domain
  DOMAIN (120)...(437): Glycosyl hydrolases family 6
  SITE (26)...(53): Cellulose-binding domain, fungal type. Prosite id = PS00562
  SITE (243)...(252): Glycosyl hydrolases family 6 signature 2. Prosite id = PS00656
  SITE (318)...(321): N-glycosylation site. Prosite id = PS00001
MRYTWSVAAALLPCAIQAQQTLYGQCGGQGYSGLTSCVAGATCSTVNEYYAQCTPAAGSATSTTLKTTTTTAGATTTTTSKTSASQTSTTKTSTSTASTTTATTTASASGNPFSGYQLYVNPYYSSEVASLAIPSLTGTLSSLQAAATAAAKVPSFVWLDVAAKVPTMATYLADIKAQNAAGANPPVAGQFVVYDLPDRDCAALASNGEYSIANNGVANYKAYIDSIRKVLVQYSDVHTILVIEPDSLANLVTNLNVAKCANAQSAYLECTNYALEQLNLPNVAMYLDAGHAGWLGWPANQQPAANLYASVYKNASSPAAVRGLATNVANYNAFTIASCPSYTQGNSVCDEQQYINAIAPLLSAQGFNAHFIVDTGRNGKQPTGQQAWGDWCNVINTGFGVRPTTNTGDALVDAFVWVKPGGESDGTSDSSATRYDAHCGYSDALQPAPEAGTWFQAYFVQLLSNANPAF

SEQ ID NO: 99 - DNA, 1041 bp, Unknown
  Obtained from environmental sample
atgatcagtctcaaacgagtggcggcgctcctgtgcgtcgcaggtctgggcatgtctgcggcaaacgcgcagacctgcctcacgtcgagtcaaaccggcactaacaatggcttctattattccttctggaaggacagtccgggcacggtgaatttttgcctgcagtccggcggccgttacacatcgaactggagcggcatcaacaactgggtgggcggcaagggatggcagaccggttcacgccggaacatcacgtactcgggcagcttcaattcaccgggcaacggctacctggcgctttacggatggaccaccaatccactcgtcgagtactacgtcgtcgatagctgggggagctggcgtccgccgggttcggacggaacgttcctggggacggtcaacagcgatggcggaacgtatgacatctatcgcgcgcagcgggtcaacgcgccgtccatcatcggcaacgccacgttctatcaatactggagcgttcggcagtcgaagcgggtaggtgggacgatcaccaccggaaaccacttcgacgcgtgggccagcgtgggcctgaacctgggcactcacaactaccagatcatggcgaccgagggctaccaaagcagcggcagctccgacatcacggtgagtgaaggcggtagcagcagtggtggcggaagcagcacgagcagcagcagcggcggtggtggcaccaagagcttcacggttcgtgcgcgcggtaccgcgggcggtgagtccatcacgctgcgcgtgaacaaccagaacgtgcagacctggacgctgggcaccagcatgacgaactacacggcgtcgacttcactgagcggcggcatcaccgtggtgtacacgaacgacagcggtaaccgcgacgtgcaggtggactacatcgtcgtgaacggccagacgcgccagtccgaagcccagagctacaacaccggcctttatgcgaacgggcgttgcggcggtggctccaacagcgaatggatgcattgcaacggcgccatcggctacggcaatacaccgtaa

SEQ ID NO: 100 - protein, 346 aa, Unknown
  Obtained from environmental sample
  SIGNAL (1)...(23)
  DOMAIN (33)...(214): Glycosyl hydrolases family 11
  SITE (63)...(66): N-glycosylation site. Prosite id = PS00001
  SITE (84)...(87): N-glycosylation site. Prosite id = PS00001
  SITE (108)...(118): Glycosyl hydrolases family 11 active site signature 1. Prosite id = PS00776
  SITE (158)...(161): N-glycosylation site. Prosite id = PS00001
  SITE (202)...(213): Glycosyl hydrolases family 11 active site signature 2. Prosite id = PS00777
  SITE (276)...(279): N-glycosylation site. Prosite id = PS00001
  SITE (293)...(296): N-glycosylation site. Prosite id = PS00001
MISLKRVAALLCVAGLGMSAANAQTCLTSSQTGTNNGFYYSFWKDSPGTVNFCLQSGGRYTSNWSGINNWVGGKGWQTGSRRNITYSGSFNSPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSEGGSSSGGGSSTSSSSGGGGTKSFTVRARGTAGGESITLRVNNQNVQTWTLGTSMTNYTASTSLSGGITVVYTNDSGNRDVQVDYIVVNGQTRQSEAQSYNTGLYANGRCGGGSNSEWMHCNGAIGYGNTP

SEQ ID NO: 101 - DNA, 1725 bp, Clostridium thermocellum
gtgtggaagcccggattgtggaatttccttcaaatggcagatgaagccggattgacgagggatggaaacactccggttccgacacccagtccaaagccggctaacacacgtattgaagcggaagattatgacggtattaattcttcaagtattgagataataggtgttccacctgaaggaggcagaggaataggttatattaccagtggtgattatctggtatacaagagtatagactttggaaacggagcaacgtcgtttaaggccaaggttgcaaatgcaaatacttccaatattgaacttagattaaacggtccgaatggtactctcataggcacactctcggtaaaatccacaggagattggaatacatatgaggagcaaacttgcagcattagcaaagtcaccggaataaatgatttgtacttggtattcaaaggccctgtaaacatagactggttcacttttggcgttgaaagcagttccacaggtctgggggatttaaatggtgacggaaatattaactcgtcggaccttcaggcgttaaagaggcatttgctcggtatatcaccgcttacgggagaggctcttttaagagcggatgtaaataggagcggcaaagtggattctactgactattcagtgctgaaaagatatatactccgcattattacagagttccccggacaaggtgatgtacagacacccaatccgtctgttactccgacacaaactcctatccccacgatttcgggaaatgctcttagggattatgcggaggcaaggggaataaaaatcggaacatgtgtcaactatccgttttacaacaattcagatccaacctacaacagcattttgcaaagagaattttcaatggttgtatgtgaaaatgaaatgaagtttgatgctttgcagccgagacaaaacgtttttgatttttcgaaaggagaccagttgcttgcttttgcagaaagaaacggtatgcagatgaggggacatacgttgatttggcacaatcaaaacccgtcatggcttacaaacggtaactggaaccgggattcgctgcttgcggtaatgaaaaatcacattaccactgttatgacccattacaaaggtaaaattgttgagtgggatgtggcaaacgaatgtatggatgattccggcaacggcttaagaagcagcatatggagaaatgtaatcggtcaggactaccttgactatgctttcaggtatgcaagagaagcagatcccgatgcacttcttttctacaatgattataatattgaagacttgggtccaaagtccaatgcggtatttaacatgattaaaagtatgaaggaaagaggtgtgccgattgacggagtaggattccaatgccactttatcaatggaatgagccccgagtaccttgccagcattgatcaaaatattaagagatatgcggaaataggcgttatagtatcctttaccgaaatagatatacgcatacctcagtcggaaaacccggcaactgcattccaggtacaggcaaacaactataaggaacttatgaaaatttgtctggcaaaccccaattgcaatacctttgtaatgtggggattcacagataaatacacatggattccgggaactttcccaggatatggcaatccattgatttatgacagcaattacaatccgaaaccggcatacaatgcaataaaggaagctcttatgggctattga

SEQ ID NO: 102 - protein, 574 aa, Clostridium thermocellum
  DOMAIN (39)...(158): Carbohydrate binding module (family 6)
  DOMAIN (167)...(187): Dockerin type I repeat
  DOMAIN (201)...(221): Dockerin type I repeat
  DOMAIN (254)...(571): Glycosyl hydrolase family 10
  SITE (47)...(50): N-glycosylation site. Prosite id = PS00001
  SITE (96)...(99): N-glycosylation site. Prosite id = PS00001
  SITE (108)...(111): N-glycosylation site. Prosite id = PS00001
  SITE (169)...(181): EF-hand calcium-binding domain. Prosite id = PS00018
  SITE (169)...(188): Clostridium cellulosome enzymes repeated domain signature. Prosite id = PS00448
  SITE (177)...(180): N-glycosylation site. Prosite id = PS00001
  SITE (204)...(216): EF-hand calcium-binding domain. Prosite id = PS00018
  SITE (204)...(223): Clostridium cellulosome enzymes repeated domain signature. Prosite id = PS00448
  SITE (206)...(209): N-glycosylation site. Prosite id = PS00001
  SITE (280)...(283): N-glycosylation site. Prosite id = PS00001
  SITE (491)...(501): Glycosyl hydrolases family 10 active site. Prosite id = PS00591
MWKPGLWNFLQMADEAGLTRDGNTPVPTPSPKPANTRIEAEDYDGINSSSIEIIGVPPEGGRGIGYITSGDYLVYKSIDFGNGATSFKAKVANANTSNIELRLNGPNGTLIGTLSVKSTGDWNTYEEQTCSISKVTGINDLYLVFKGPVNIDWFTFGVESSSTGLGDLNGDGNINSSDLQALKRHLLGISPLTGEALLRADVNRSGKVDSTDYSVLKRYILRIITEFPGQGDVQTPNPSVTPTQTPIPTISGNALRDYAEARGIKIGTCVNYPFYNNSDPTYNSILQREFSMVVCENEMKFDALQPRQNVFDFSKGDQLLAFAERNGMQMRGHTLIWHNQNPSWLTNGNWNRDSLLAVMKNHITTVMTHYKGKIVEWDVANECMDDSGNGLRSSIWRNVIGQDYLDYAFRYAREADPDALLFYNDYNIEDLGPKSNAVFNMIKSMKERGVPIDGVGFQCHFINGMSPEYLASIDQNIKRYAEIGVIVSFTEIDIRIPQSENPATAFQVQANNYKELMKICLANPNCNTFVMWGFTDKYTWIPGTFPGYGNPLIYDSNYNPKPAYNAIKEALMGY

SEQ ID NO: 103 - DNA, 930 bp, Cochliobolus heterostrophus
  misc_feature: Cochliobolus heterostrophus ATCC 48331 DNA
gtgtcgcccaagcaggacagccgtcaaatccagggtatcaaggacccgacgattatccagaacaatggtgtataccatgtctttgccagcacggccaaggaagcgggatacaacctagtctacttcaactttaccgacttcagcagggccaaccaggcgccattcttctacctcgaccagtcaggtatcggcacaggttaccgtgctgctcctcaagtcttctacttcgccccccagaagctctggtacctcatctaccaaaacggcaatgcagcatacagcaccaaccccgacatttccaacccacgaggctggaccgccccgcaagtcttctaccccaacggaaccccccagacgatccaaaacggcctaggaacgaccggctactgggtcgacatgtgggtaatctgcgacacggccctctgccacctgtactcatccgacgacaacggcggcctataccgcagccaaacgcccgtctcgcaattcccacgcggcatgaacgagcccgtggtaacgctcaaggccaacaaaaacgacctctttgaagcctcgaccgtgtacaacattgtaaacaccagcacctacctcctcatggtcgaatgcatcggctccggcaactcccccggcggcctgcgctacttccgctcctggaccacccagtccctcaccagcgacaagtggactccccttgccgcatcccagcaaacccctttcctcggcgccgctaacacccagttccccgccggccgctggtcccagagcttgtcccacggcgagctcgttcgcacaaatgtagaccagaggctccagattcgcccctgtgaaatgaggtacctctaccagggtatcgatcctaatgctacgggcacttacaatgccctgccctggaaactcgcccttgcaacccagacaaactccaagtgttag

SEQ ID NO: 104 - protein, 309 aa, Cochliobolus heterostrophus
  DOMAIN (1)...(309): Cochliobolus heterostrophus ATCC 48331 protein
  DOMAIN (3)...(276): Glycosyl hydrolase family 62
  SITE (43)...(46): N-glycosylation site. Prosite id = PS00001
  SITE (194)...(197): N-glycosylation site. Prosite id = PS00001
  SITE (291)...(294): N-glycosylation site. Prosite id = PS00001
MSPKQDSRQIQGIKDPTIIQNNGVYHVFASTAKEAGYNLVYFNFTDFSRANQAPFFYLDQSGIGTGYRAAPQVFYFAPQKLWYLIYQNGNAAYSTNPDISNPRGWTAPQVFYPNGTPQTIQNGLGTTGYWVDMWVICDTALCHLYSSDDNGGLYRSQTPVSQFPRGMNEPVVTLKANKNDLFEASTVYNIVNTSTYLLMVECIGSGNSPGGLRYFRSWTTQSLTSDKWTPLAASQQTPFLGAANTQFPAGRWSQSLSHGELVRTNVDQRLQIRPCEMRYLYQGIDPNATGTYNALPWKLALATQTNSKC

SEQ ID NO: 105 - DNA, 1365 bp, Clostridium thermocellum
gtgaaaaaaattgtttctttggtttgtgtgcttgtgatgctggtaagcatcttaggctcgttttcagtcgtagcggcatcaccggtaaaaggctttcaggtatcgggaacaaagcttttggatgcaagcggaaacgagcttgtaatgaggggcatgcgtgatatttcagcaatagatttggttaaagaaataaaaatcggatggaatttgggaaatactttggatgctcctacagagactgcctggggaaatccaaggacaaccaaggcaatgatagaaaaggtaagggaaatgggctttaatgccgtcagagtgcctgttacctgggatacgcacatcggacctgctccggactataaaattgacgaagcatggctgaacagagttgaggaagtggtaaactatgttcttgactgcggtatgtacgcgatcataaatgttcaccatgacaatacatggattatacctacatatgccaatgagcaaaggagtaaagaaaaacttgtaaaagtttgggaacaaatagcaacccgttttaaagattatgacgaccatttgttgtttgagacaatgaacgaaccgagagaagtaggttcacctatggaatggatgggcggaacgtatgaaaaccgagatgtgataaacagatttaatttggcggttgttaataccatcagagcaagcggcggaaataacgataaaagattcatactggttccgaccaatgcggcaaccggcctggatgttgcattaaacgaccttgtcattccgaacaatgacagcagagtcatagtatccatacatgcttattcaccgtatttctttgctatggatgtcaacggaacttcatattggggaagtgactatgacaaggcttctcttacaagtgaacttgatgctatttacaacagatttgtgaaaaacggaagggctgtaattatcggagaattcggaaccattgacaagaacaacctgtcttcaagggtggctcatgccgagcactatgcaagagaagcagtttcaagaggaattgctgttttctggtgggataacggctattacaatccgggtgatgcagagacttatgcattgctgaacagaaaaactctctcatggtattatcctgaaattgtccaggctcttatgagaggtgccggcgttgaacctttagtttcaccgactcctacacctacattaatgccgaccccctcgcccacggtgacagcaaatattttgtacggtgacgtaaacggggacggaaaaataaattctacagactgtacaatgctaaagagatatattttgcgtggcatagaagaattcccaagtcctagcggaattatagccgctgacgtaaatgcggat

SEQ ID NO: 106 - protein, 455 aa, Clostridium thermocellum
  SIGNAL (1)...(25)
  DOMAIN (71)...(359): Cellulase (glycosyl hydrolase family 5)
  DOMAIN (415)...(435): Dockerin type I repeat
  SITE (188)...(197): Glycosyl hydrolases family 5 signature. Prosite id = PS00659
  SITE (284)...(287): N-glycosylation site. Prosite id = PS00001
  SITE (421)...(440): Clostridium cellulosome enzymes repeated domain signature. Prosite id = PS00448
  SITE (429)...(432): N-glycosylation site. Prosite id = PS00001
MKKIVSLVCVLVMLVSILGSFSVVAASPVKGFQVSGTKLLDASGNELVMRGMRDISAIDLVKEIKIGWNLGNTLDAPTETAWGNPRTTKAMIEKVREMGFNAVRVPVTWDTHIGPAPDYKIDEAWLNRVEEVVNYVLDCGMYAIINVHHDNTWIIPTYANEQRSKEKLVKVWEQIATRFKDYDDHLLFETMNEPREVGSPMEWMGGTYENRDVINRFNLAVVNTIRASGGNNDKRFILVPTNAATGLDVALNDLVIPNNDSRVIVSIHAYSPYFFAMDVNGTSYWGSDYDKASLTSELDAIYNRFVKNGRAVIIGEFGTIDKNNLSSRVAHAEHYAREAVSRGIAVFWWDNGYYNPGDAETYALLNRKTLSWYYPEIVQALMRGAGVEPLVSPTPTPTLMPTPSPTVTANILYGDVNGDGKINSTDCTMLKRYILRGIEEFPSPSGIIAADVNAD

SEQ ID NO: 107 - DNA, 948 bp, Unknown
  Obtained from environmental sample
gtgactccaacaaatacgcccatccctgctccgacattacaccgcggtgtcaactttggtaacatgctcgaaccacccaacgaaggtgaatggggactgtatgtacaggaggaatatttcaaccttgtaaaagaagcaggttttgactttgtccgtttgcctgttagttgggatgctcatgctgagggagccgaaccatacacgatcgatcctttatttttctaccgcgtggatcaagttcttgcttgggctttggatcgaaaccttacagtcattcttgattttcacaactatgacgacatgatgtccaatccgtggggaaataaggaacgtttctttgccatctggaagcaagtttcagaacgatacaaggattaccccgctaatctcctattcgagttgctcaatgagccgaattcggttctggatgcgcaactttggaatcaatatgttggtgaagcattagccatcattcgtgatacaaaccctacacgcgatgtggtgatcggtccgacacaatggaattcctatggctggatttccacgttggacgtgccagatgatccgcatatgatcttcacttttcattactacgagcctttccatttcacacatcaaggcgcggagtgggtgggcgatgaagcacaaggctggttgggtacaacctgggatgcgaccgatgagcagaaagctgaagtcatcaataactttgactcggttgccgattggtcgaagcgacatggaaacgtccgcattttgctcggtgagtttggcgcatactcgacagctccgcaagactcacgcgtccgttggacgacgtttatccgtgagcaggcagaagctcacgggttcgcgtgggcttattgggaactggcggcaggcttcggggtgtatgatccggatgccaaagcgtggagagaagatctgttgaaggcattgatcccctga

SEQ ID NO: 108 - protein, 315 aa, Unknown
  Obtained from environmental sample
  DOMAIN (20)...(298): Cellulase (glycosyl hydrolase family 5)
  SITE (89)...(92): N-glycosylation site. Prosite id = PS00001
MTPTNTPIPAPTLHRGVNFGNMLEPPNEGEWGLYVQEEYFNLVKEAGFDFVRLPVSWDAHAEGAEPYTIDPLFFYRVDQVLAWALDRNLTVILDFHNYDDMMSNPWGNKERFFAIWKQVSERYKDYPANLLFELLNEPNSVLDAQLWNQYVGEALAIIRDTNPTRDVVIGPTQWNSYGWISTLDVPDDPHMIFTFHYYEPFHFTHQGAEWVGDEAQGWLGTTWDATDEQKAEVINNFDSVADWSKRHGNVRILLGEFGAYSTAPQDSRVRWTTFIREQAEAHGFAWAYWELAAGFGVYDPDAKAWREDLLKALIP

SEQ ID NO: 109 - DNA, 1401 bp, Unknown
  Obtained from environmental sample
atgagtagctttaaagcctctgcgatcaaccctcgcatggcgggtgcgctaacacgctccctctatgcggccgggttctccctggctgtatccactctttccacacaggcttatgccggttgccagtacgtggtcaacaaccagtggaataatggattcgatgccaaaataagaataactaacgacgggacaaccgcgatcaacggctggaacattagctggcgatacaatggcgataaccgcatcaccagcagttacaacgccactttgtcaggcaccaacccttactccgctaccaacctgagctggaatggcaatatccaacccggccaggctgttgagtttggattccagggcagcaaaggcgccgccgccgctgaagtacctgtgattaccggcaccgcttgtggtactacgaccgcttcttctgctgcgcgctcttccaccacaaccacttcagtaccggcaacttccagttcccgctcgtccaccgcagtggcatcaagcgttggcaatgttacccaaggtgttgcgcctttggtggtccaaggcaacaaggtaactgccaatggccaacccgctaacctcgccggcatgagcctgttctggagcaacaccgggtggggcggtgaaaagtattacaacgcccaagtggtgtcctggttgaaatcagactggaaagccaacctcgtacgcgttgccatgggcgttgaagatgcgggcggttatttgaccgactccaccaacaagactcgtgcaaccaccgttattgatgcggcgattgccaataacatgtatgtcattatcgactggcatacccatcgcgccgaaaataacaaagccgctgccgtagctttcttcaaagaaatggctaccaagtatggccaatacaacaacgtgatttacgaggtatacaacgaacctctgaacgtctcctggagtggggtcatcaagccctacgcaactgatgtcatcaaggaaatccgtgccatcgacccggacaacctgattatcgtagggactcccaactggtcacaagacgtcgatgtggccgcaaatgatcccatcaccacctacagcaacatcgcctacaccctgcacttctacgcgggcacccacaagcaattcctgcgtgacaaggcacaaaccgcccttaaccgtggcattgccttgttcgttaccgagtggggctcagtgaatgcggacggtggcggtgctgtggatgcagcagaaaccaacacctggttgaacttcctcaaaaccaacggcattagccatgctaactgggctttgaatgataaagccgaaggcgcttctgctttggttcccggtgcgagcgcaaacggtggctggaccagtgcccagctgaccgcatcaggcacgttgattcgcaatgcgatt

SEQ ID NO: 110 - protein, 467 aa, Unknown
  Obtained from environmental sample
  DOMAIN (39)...(136): Cellulose binding domain
  DOMAIN (184)...(439): Cellulase (glycosyl hydrolase family 5)
  SITE (72)...(75): N-glycosylation site. Prosite id = PS00001
  SITE (88)...(91): N-glycosylation site. Prosite id = PS00001
  SITE (101)...(104): N-glycosylation site. Prosite id = PS00001
  SITE (174)...(177): N-glycosylation site. Prosite id = PS00001
  SITE (252)...(255): N-glycosylation site. Prosite id = PS00001
  SITE (304)...(313): Glycosyl hydrolases family 5 signature. Prosite id = PS00659
  SITE (314)...(317): N-glycosylation site. Prosite id = PS00001
  SITE (348)...(351): N-glycosylation site. Prosite id = PS00001
MSSFKASAINPRMAGALTRSLYAAGFSLAVSTLSTQAYAGCQYVVNNQWNNGFDAKIRITNDGTTAINGWNISWRYNGDNRITSSYNATLSGTNPYSATNLSWNGNIQPGQAVEFGFQGSKGAAAAEVPVITGTACGTTTASSAARSSTTTTSVPATSSSRSSTAVASSVGNVTQGVAPLVVQGNKVTANGQPANLAGMSLFWSNTGWGGEKYYNAQVVSWLKSDWKANLVRVAMGVEDAGGYLTDSTNKTRATTVIDAAIANNMYVIIDWHTHRAENNKAAAVAFFKEMATKYGQYNNVIYEVYNEPLNVSWSGVIKPYATDVIKEIRAIDPDNLIIVGTPNWSQDVDVAANDPITTYSNIAYTLHFYAGTHKQFLRDKAQTALNRGIALFVTEWGSVNADGGGAVDAAETNTWLNFLKTNGISHANWALNDKAEGASALVPGASANGGWTSAQLTASGTLIRNAI

SEQ ID NO: 111 - DNA, 2043 bp, Unknown
  Obtained from environmental sample
atgagtagctttaaagcctctgcgatcaaccctcgcatggcgggtgcgctaacacgctccctctatgcggccgggttctccctggctgtatccactctttccacacaggcttatgccggttgccagtacgtggtcaacaaccagtggaataatggattcgatgccaaaataagaataactaacgacgggacaaccgcgatcaacggctggaacattagctggcgatacaatggcgataaccgcatcaccagcagttacaacgccactttgtcaggcaccaacccttactccgctaccaacctgagctggaatggcaatatccaacccggccaggctgttgagtttggattccagggcagcaaaggcgccgccgccgctgaagtacctgtgattaccggcaccgcttgtggtactacgaccgcttcttctgctgcgcgctcttccaccacaaccacttcagtaccggcaacttccagttcccgctcgtccaccgcagtggcatcaagcgttggcaatgttacccaaggtgttgcgcctttggtggtccaaggcaacaaggtaactgccaatggccaacccgctaacctcgccggcatgagcctgttctggagcaacaccgggtggggcggtgaaaagtattacaacgcccaagtggtgtcctggttgaaatcagactggaaagccaacctcgtacgcgttgccatgggcgttgaagatgcgggcggttatttgaccgactccaccaacaagactcgtgcaaccaccgttattgatgcggcgattgccaataacatgtatgtcattatcgactggcatacccatcgcgccgaaaataacaaagccgctgccgtagctttcttcaaagaaatggctaccaagtatggccaatacaacaacgtgatttacgaggtatacaacgaacctctgaacgtctcctggagtggggtcatcaagccctacgcaactgatgtcatcaaggaaatccgtgccatcgacccggacaacctgattatcgtagggactcccaactggtcacaagacgtcgatgtggccgcaaatgatcccatcaccacctacagcaacatcgcctacaccctgcacttctacgcgggcacccacaagcaattcctgcgtgacaaggcacaaaccgcccttaaccgtggcattgccttgttcgttaccgagtggggctcagtgaatgcggacggtggcggtgctgtggatgcagcagaaaccaacacctggttgaacttcctcaaaaccaacggcattagccatgctaactgggctttgaatgataaagccgaaggcgcttctgctttggttcccggtgcgagcgcaaacggtggctggaccagtgcccagctgaccgcatcaggcacgttgattcgcaatgcgattattgccaacaacaacggcaccacctcaagtgcggcaccttccagcatcccgcgtagttcggtggctccgtcatcggtagctcgttcttccagtagttcagtaacaccaagctcggtacccgcgtcttcagttgcacccagctctagcagccgtgccgcctcctcagtggccaacactgccgcctggaacctgaataccaccgattcttacctgaacttcgtgaccaccaagaacacccacaacgtggaagttcatagcttcaccggcttgactggcgatatcagcagcgcgggcgtagccaccctgaccatcgacctcaacagtgtgaacaccggtgtagccctgcgcgaccaacgcatgaaggacctgctgtttgaaacagcaacctacccgactgcgactgtcactgtcaccgtacctactacagtgatcagcagcctggccgttggccaatcagccgctaccgatatctctgccaccctggacctgcacggtgtgactggcactatcaccaccaaagtctctgtccagaaactgtccaacagccgcatcctggtgcaaaccctggcgccggtattggttaaagcgggcgactactcgctcaccaatggtgtggaagcactgcgtgctgcggtagcaatt

SEQ ID NO: 112 - protein, 681 aa, Unknown
  Obtained from environmental sample
  DOMAIN (39)...(136): Cellulose binding domain
  DOMAIN (184)...(439): Cellulase (glycosyl hydrolase family 5)
  DOMAIN (526)...(677): YceI like family
  SITE (72)...(75): N-glycosylation site. Prosite id = PS00001
  SITE (88)...(91): N-glycosylation site. Prosite id = PS00001
  SITE (101)...(104): N-glycosylation site. Prosite id = PS00001
  SITE (174)...(177): N-glycosylation site. Prosite id = PS00001
  SITE (252)...(255): N-glycosylation site. Prosite id = PS00001
  SITE (304)...(313): Glycosyl hydrolases family 5 signature. Prosite id = PS00659
  SITE (314)...(317): N-glycosylation site. Prosite id = PS00001
  SITE (348)...(351): N-glycosylation site. Prosite id = PS00001
  SITE (479)...(482): N-glycosylation site. Prosite id = PS00001
  SITE (540)...(543): N-glycosylation site. Prosite id = PS00001
MSSFKASAINPRMAGALTRSLYAAGFSLAVSTLSTQAYAGCQYVVNNQWNNGFDAKIRITNDGTTAINGWNISWRYNGDNRITSSYNATLSGTNPYSATNLSWNGNIQPGQAVEFGFQGSKGAAAAEVPVITGTACGTTTASSAARSSTTTTSVPATSSSRSSTAVASSVGNVTQGVAPLVVQGNKVTANGQPANLAGMSLFWSNTGWGGEKYYNAQVVSWLKSDWKANLVRVAMGVEDAGGYLTDSTNKTRATTVIDAAIANNMYVIIDWHTHRAENNKAAAVAFFKEMATKYGQYNNVIYEVYNEPLNVSWSGVIKPYATDVIKEIRAIDPDNLIIVGTPNWSQDVDVAANDPITTYSNIAYTLHFYAGTHKQFLRDKAQTALNRGIALFVTEWGSVNADGGGAVDAAETNTWLNFLKTNGISHANWALNDKAEGASALVPGASANGGWTSAQLTASGTLIRNAIIANNNGTTSSAAPSSIPRSSVAPSSVARSSSSSVTPSSVPASSVAPSSSSRAASSVANTAAWNLNTTDSYLNFVTTKNTHNVEVHSFTGLTGDISSAGVATLTIDLNSVNTGVALRDQRMKDLLFETATYPTATVTVTVPTTVISSLAVGQSAATDISATLDLHGVTGTITTKVSVQKLSNSRILVQTLAPVLVKAGDYSLTNGVEALRAAVAI

SEQ ID NO: 113 - DNA, 2661 bp, Unknown
  Obtained from environmental sample
atgagtagctttaaagcctctgcgatcaaccctcgcatggcaggtacgctaacgcgttccctctatgcggccgggttctccctggctgtatccactctttccacccaggcctatgccggttgccagtacgtgatcgacagccagtggaataatgggttcggcgccaaaataagaataaccaatgatgggacaactgcgatcaatggctggaatgtgagctggcgatacagcggcgataaccgcattaccagcagttacaacgccaccctgaccggttccaacccctactccgccactaacctgagctggaacgctaccatccagccaaagcaaaccgttgagtttggtttccagggctccaaaggcgccgcagcggctgaagtgccagtgattaccggtacgggttgtggtactgccacctcctcggcagccccatcatcagccccacccgtctcatcagcaccaactaccagctcacgctcctcggccgcgtccagcaatggcactgtccaaggcgtagcacccctggtagtacagggcaacaaagtaaccgccaatggccaaccggccaacctggcgggcatgagcctgttctggagtaacaccggctggggcggcgagaaatactacaacgcccaggtagtttcctggctgaaatccgactggaaagccaatctgatccgtgttgctatgggcacggaagaagccggtggctacctgaccgacgcctccaacaaaacccgtgctaccgccgtaattgatgcggcgattgccaacaacatgtatgtcattatcgattggcatacccatcacgctgaagataacaaggccgctgccattaccttcttcaaggaaatggcaaccaagtacggcaactacaacaacgtgatctatgaggtatacaacgagccgttgaatatctcctggagcggtgtactcaagccatacgcgactgatgtgatccgcgaaatccgtgccattgacccggacaacctgattattgtaggtacgcctaactggtctcaggacgttgacgtagccgctaacgacccgatcaccgcctacagcaacattgcctacaccctgcacttctatgccggtacccacaaacaattcctgcgtgacaaggcgcaaaccgcactgaatcgcggcattgccctgtttgttaccgagtggggtgcagtgaatgccgatggcggtggcggtgtggattcagccgagaccgcgacctggttgaacttcctcaaaaccaacggcatcagccatgccaactgggcattgaatgataaggccgagggcgcttctgccctggtgcccggcgccagtgtcaacggtggctggaccagcgcacaactgaccgcatccggcaccctggtgcgtaacgcgatcatcgccaacaacggcaatgtgaccagctctaccccggctacctcttcacgcagctcggtaccgtccagcagctcggtcgccctcacctccagctcgcgttccagcagctcggtggcgattggcagcagctcgtctaccaacaacaatggcggcggcgtactcttctccgaaacctttgaaaacggtgcagtcaatacccaaccggctggctgggaaaacttcatcggctacgtacgcaacaataacaacaccacctccggttcggcttatgccttgatcgatagcagcaaagcctacagcggtggcaagtctatccgtttcaaaggcggttcatcgccagcgcaaatcgtgcgcgccctgcctgctggcacccaacgcctctacacccgcgcttacgtgaacatgagcgtagctatgggtaatgtggcgggtgacaaccacgaacacatcttcggtatcaagaaaagcttcgatgccaataatgaaattcgtgtcggtcaaatcaaaggggtattgggtaccaaccacgttcctagcgataacatcgcgcccaaacaaagccagtggtacagcggcccgcaaatggcagccaacagatggtactgcgtggaaacggcttacctggccgatgaagcctatgacaccttgcatatgtgggtagatggcaatctggttcacactgtcgattcatctgacgactggaacaacggcgccctgagtgccaattggttgagcgataactttaacttcgtcatgttcggcttccacagcttcagcaaccgcaatgcggatgtctggatggacgacatcgtggtttctacccaacctatcggttgcggtaccgtaaacccacccagcagcagctcggtcgcctcggttgtaccaagctcctccagccgcagctcggtagcaccttcatcatccagcgttgctatcaccagcagttcagtaccttcgtcctctgttgcgccaagctccagcagccgctccagctcgtctgttgccaacaccgctgcctggaacctgaacaccaccgactcctacctgaacttcgtcaccaccaaaaacacccacaacgtcgaagtgcatagcttcaccgggttaacaggtgacatcagcagcgctggcgttgcgaccctgaccattgacctcagcagcgtgagcaccggtgtgacactgcgtgacgagcgtatgagggatttgttgtttgaaacagcgacctatccaacggccaccatcacagtgactgtgccttctaccctgatccactag

SEQ ID NO: 114 - protein, 886 aa, Unknown
  Obtained from environmental sample
  SIGNAL (1)...(39)
  DOMAIN (39)...(136): Cellulose binding domain
  DOMAIN (180)...(435): Cellulase (glycosyl hydrolase family 5)
  SITE (72)...(75): N-glycosylation site. Prosite id = PS00001
  SITE (88)...(91): N-glycosylation site. Prosite id = PS00001
  SITE (101)...(104): N-glycosylation site. Prosite id = PS00001
  SITE (105)...(108): N-glycosylation site. Prosite id = PS00001
  SITE (169)...(172): N-glycosylation site. Prosite id = PS00001
  SITE (248)...(251): N-glycosylation site. Prosite id = PS00001
  SITE (300)...(309): Glycosyl hydrolases family 5 signature. Prosite id = PS00659
  SITE (310)...(313): N-glycosylation site. Prosite id = PS00001
  SITE (344)...(347): N-glycosylation site. Prosite id = PS00001
  SITE (476)...(479): N-glycosylation site. Prosite id = PS00001
  SITE (553)...(556): N-glycosylation site. Prosite id = PS00001
  SITE (606)...(609): N-glycosylation site. Prosite id = PS00001
  SITE (818)...(821): N-glycosylation site. Prosite id = PS00001
MSSFKASAINPRMAGTLTRSLYAAGFSLAVSTLSTQAYAGCQYVIDSQWNNGFGAKIRITNDGTTAINGWNVSWRYSGDNRITSSYNATLTGSNPYSATNLSWNATIQPKQTVEFGFQGSKGAAAAEVPVITGTGCGTATSSAAPSSAPPVSSAPTTSSRSSAASSNGTVQGVAPLVVQGNKVTANGQPANLAGMSLFWSNTGWGGEKYYNAQVVSWLKSDWKANLIRVAMGTEEAGGYLTDASNKTRATAVIDAAIANNMYVIIDWHTHHAEDNKAAAITFFKEMATKYGNYNNVIYEVYNEPLNISWSGVLKPYATDVIREIRAIDPDNLIIVGTPNWSQDVDVAANDPITAYSNIAYTLHFYAGTHKQFLRDKAQTALNRGIALFVTEWGAVNADGGGGVDSAETATWLNFLKTNGISHANWALNDKAEGASALVPGASVNGGWTSAQLTASGTLVRNAIIANNGNVTSSTPATSSRSSVPSSSSVALTSSSRSSSSVAIGSSSSTNNNGGGVLFSETFENGAVNTQPAGWENFIGYVRNNNNTTSGSAYALIDSSKAYSGGKSIRFKGGSSPAQIVRALPAGTQRLYTRAYVNMSVAMGNVAGDNHEHIFGIKKSFDANNEIRVGQIKGVLGTNHVPSDNIAPKQSQWYSGPQMAANRWYCVETAYLADEAYDTLHMWVDGNLVHTVDSSDDWNNGALSANWLSDNFNFVMFGFHSFSNRNADVWMDDIVVSTQPIGCGTVNPPSSSSVASVVPSSSSRSSVAPSSSSVAITSSSVPSSSVAPSSSSRSSSSVANTAAWNLNTTDSYLNFVTTKNTHNVEVHSFTGLTGDISSAGVATLTIDLSSVSTGVTLRDERMRDLLFETATYPTATITVTVPSTLIH

SEQ ID NO: 115 - DNA, 2034 bp, Unknown
  Obtained from environmental sample
atgaggaaaattattttaaagttttgtgcactcatgatggtagtgattttgattgtttccattttacaaatattacctgtatttgcccagagcataccgtatgaaaaggaaaaatatccacatcttcttggcaatcaggtagttaaaaaaccatcggttgccggcagactgcagattattgaaaaggacggaaaaaagtatttagctgaccagaaaggagaaataattcagcttcgtggtatgagtacacatggacttcagtggtatggtgatattataaacaaaaatgcatttgaagctctttcaaaagattgggagtgcaacgttataaggcttgcgatgtatgtgggtgaaggcggctatgcttcaaatccaagtattaaagaaaaagttatagaagggattaagcttgctattgagaatgacatgtatgtaattgttgactggcatgtattaaatcccggtgacccgaacgcagaaatttataaaggggcaaaagactttttcaaagagatagctacaagttttcccaatgactatcacataatatatgaactttgcaatgaaccaaatccaaatgaaccgggagtagaaaatagcttggatggctggaaaaaagtaaaggcttatgcacagcccatcataaaaatgctcagaagtttggggaatcagaacattataattgtaggttcgccaaactggagtcagagacctgactttgcaattcaagaccctataaatgataaaaatgttatgtattcagttcatttttactctggaactcacaaagttgatggatatgtttttgaaaacatgaaaaatgcgtttgaaaatggcgtgccaattttcgtgagtgaatggggaacaagtttggcaagcggtgatggtggaccgtatcttgatgaagcagataagtggcttgaatatttaaattcaaactatattagctgggtgaactggtcgctgtcaaacaaaaatgagacatcagctgcttttgttccatatataaacggtatgcatgatgccacaccacttgaccctggtgatgataaggtgtgggacatagaagagcttagtatttctggagagtatgtgagggcaaggataaaaggaattgcttatcagccaattaagagagataacaaaataaaagaaggagaaaatgcacctttaggcgaaaaagtcttaccatccacgtttgaagatgacactcgtcagggctgggattgggatggaccatctggtgtgaaaggtcctattactatcgaaagtgcgaatggttcaaaagcgctatcttttaattttgagtatccagagaaaaaaccacaagatggctgggcaacagctgcaaggcttatacttaaagacataaatgtagaaaggggaaataataaatatttggcttttgatttttatttgaaaccagatagggcttcaaaaggtatgattcagatatttttagctttttcacctccttccttaggttactgggctcaggtacaagacagttttaatattgaccttgcaaaactgtcaagtgcaaaaaagatagaagacagaatttataagttcaatgtattttttgacttagacaagatacaagataataaagtactgagtccagacacactcttgagagatataatagtagtcatagcagatggcaatagcgattttaaggggaaaatgtatatagataatgttagatttaccaatatcctttttgaggatatcaattttgaaaatagcctttatgatgttatcgacaagctttattctaaaggaatcataaaaggaatttcagtatttaagtacttgccagataaaaccattacaagggctgaatttgctgcactttgtgtcagggcactgaacctgaaaattgaaaaatacgatggtagattttctgatgtgaaaagcggcaactggtattcagatgtagtttatacggcgtataaaaataaattgtttgaaataaaagagaataaattctttcctgaaaatattttaaaaagagaagaagcagtagctttg

SEQ ID NO: 116 - protein, 678 aa, Unknown
  Obtained from environmental sample
  SIGNAL (1)...(29)
  DOMAIN (66)...(330): Cellulase (glycosyl hydrolase family 5)
  DOMAIN (352)...(571): Carbohydrate binding domain (family 17/28)
  DOMAIN (575)...(617): S-layer homology domain
  DOMAIN (635)...(676): S-layer homology domain
  SITE (184)...(193): Glycosyl hydrolases family 5 signature. Prosite id = PS00659
  SITE (236)...(239): N-glycosylation site. Prosite id = PS00001
  SITE (323)...(326): N-glycosylation site. Prosite id = PS00001
  SITE (331)...(334): N-glycosylation site. Prosite id = PS00001
  SITE (432)...(435): N-glycosylation site. Prosite id = PS00001
MRKIILKFCALMMVVILIVSILQILPVFAQSIPYEKEKYPHLLGNQVVKKPSVAGRLQIIEKDGKKYLADQKGEIIQLRGMSTHGLQWYGDIINKNAFEALSKDWECNVIRLAMYVGEGGYASNPSIKEKVIEGIKLAIENDMYVIVDWHVLNPGDPNAEIYKGAKDFFKEIATSFPNDYHIIYELCNEPNPNEPGVENSLDGWKKVKAYAQPIIKMLRSLGNQNIIIVGSPNWSQRPDFAIQDPINDKNVMYSVHFYSGTHKVDGYVFENMKNAFENGVPIFVSEWGTSLASGDGGPYLDEADKWLEYLNSNYISWVNWSLSNKNETSAAFVPYINGMHDATPLDPGDDKVWDIEELSISGEYVRARIKGIAYQPIKRDNKIKEGENAPLGEKVLPSTFEDDTRQGWDWDGPSGVKGPITIESANGSKALSFNFEYPEKKPQDGWATAARLILKDINVERGNNKYLAFDFYLKPDRASKGMIQIFLAFSPPSLGYWAQVQDSFNIDLAKLSSAKKIEDRIYKFNVFFDLDKIQDNKVLSPDTLLRDIIVVIADGNSDFKGKMYIDNVRFTNILFEDINFENSLYDVIDKLYSKGIIKGISVFKYLPDKTITRAEFAALCVRALNLKIEKYDGRFSDVKSGNWYSDVVYTAYKNKLFEIKENKFFPENILKREEAVAL

SEQ ID NO: 117 - DNA, 2244 bp, Unknown
  Obtained from environmental sample
atgaaaaagagacaaggttttatcaaaaaagggctggttttgggcgtttcattgcttttgctggcgttgatcatgatgagcgccacatcgcaaacatcggccagtccacagaatccgtttttatggccttataatcaaccgacccacatcagctttaacgaagccgacgtgtatcaggcgtggacggtctggcgcgacgcgcagattacggcgaacaatgcggggggaaacggccgttaccgggtcatgggcggcgtggatggcggcagcaccgtctccgaagggcaggcttacggcattctcttcgcttccatctttgacgagcaaaccctgtttgacggtttgttcctgttcgccaaagaccactataacgaaaacggcgtcatggactggcatatcggcagccctggtgtgcgtattggcagcggcggcgccaccgacgctgaagtggacatggcgttaggattggtcaacgcctgcgtcaaagtgcagaaaaacgcctggcctgccagtccggccggcgtcaactactgcgtcgaagccactaacctgatcaacgccatttatacctacgaggtagaccatgccggcagtgcccctcctggcgggctgcccaacaatcagggcaacgaactgctgcccggtgatacctggaacatcagcgaactttatccacaaggcatcatcaacctctcctacttcccgcccggctatttcaccgttttcggcaagtttacgggcaacgaagccgcctggaacgccgtcatcaatcgcaactatcaggtggtggacatggtgcaggccaaaccgaataactgctccggactggtgcctaactggaataattacaacggcgacgcccaactcgtctcctggcagaccaacaattacagttggtggagctacgacgcggcccgtttcgcctggcgtattgccgtcgatcaggcctggtacggccgttctgaggccgccgaaaccatgaatgaaattggcggtttcttcagcagtaccggcttcaacaacatcggcgaacacaacatgaatgggcagcgggtgggcagtggtccctggcctttctttgtggcgaatgcggcggcggcggtgtgggcagcgcccaatgcaacggccgttaactgcggtacagccacaggttcgctgcaggaaagcgcccaatccgcttataaccgggtgctgaccagcaaagacacgcccaacagctactacggcaacgcctggcggctgttctctatgctgctcatgacgggcaacttccccaacttctacgaaatggccgacggcggcgtcacaccggttcccaccctgccgccgacccagacgccccacgccacccaaccgcctacggcgactgccaccacctcctccggcggcggcgtttgtgccgtggattacgtcattgccaaccagtggggcaatggcttccaggccaacgtcaccatcaccaatcacagcgccgtgccggtgaacggctacactctggcctggacccacgcgccggggcaggttgtcaccaacggctggaacgtgaccatcgcccaaagcggcagcgccgtcagcgccagcaatccggccagttattggaacggcgtgattggagccaacggcggcaaggtttcttttggtttccagggatctctggcaggcggcagcgcggtcgcgcccacttattttgccttgaacggcgctgcctgtaacggggccgtccttccgcccaccgccaccagtgcgccacccacacaaacggccgttccgcccaccgccaccacgatactgcccacacaaacggccgttccccctaccgccaccacgataccacccacacaaacggccgttccgcccaccgccaccagtcaaccaccgacgcaaacggccgttccccccaccgccacagctaccccgccatccggggttggcgcctgcaccgttgtctacgccatcaccaacgattggggcagcggcttcaccgccaacgtcaccctcaccaataaaagcagcgccgcccttaacggctggactctggcctatgccttccccggcaatcaaaccatcagcaatgcctggaacggaacggccgttcagtcaggtaaaaacgtcagcgtcaccaatgtaggttggaacggcagcctgccgcccaacggtgtcgccagctttggcttccaggcgagctacagcggtagtaacagcgctcctaccagctttacgctgaacgggcagcgatgcgattga

SEQ ID NO: 118 - protein, 747 aa, Unknown
  Obtained from environmental sample
  SIGNAL (1)...(34)
  DOMAIN (38)...(422): Glycosyl hydrolases family 8
  DOMAIN (466)...(570): Cellulose binding domain
  DOMAIN (646)...(746): Cellulose binding domain
  SITE (222)...(225): N-glycosylation site. Prosite id = PS00001
  SITE (233)...(236): N-glycosylation site. Prosite id = PS00001
  SITE (276)...(279): N-glycosylation site. Prosite id = PS00001
  SITE (300)...(303): N-glycosylation site. Prosite id = PS00001
  SITE (378)...(381): N-glycosylation site. Prosite id = PS00001
  SITE (490)...(493): N-glycosylation site. Prosite id = PS00001
  SITE (495)...(498): N-glycosylation site. Prosite id = PS00001
  SITE (521)...(524): N-glycosylation site. Prosite id = PS00001
  SITE (673)...(676): N-glycosylation site. Prosite id = PS00001
  SITE (678)...(681): N-glycosylation site. Prosite id = PS00001
  SITE (696)...(699): N-glycosylation site. Prosite id = PS00001
  SITE (704)...(707): N-glycosylation site. Prosite id = PS00001
  SITE (713)...(716): N-glycosylation site. Prosite id = PS00001
  SITE (722)...(725): N-glycosylation site. Prosite id = PS00001
MKKRQGFIKKGLVLGVSLLLLALIMMSATSQTSASPQNPFLWPYNQPTHISFNEADVYQAWTVWRDAQITANNAGGNGRYRVMGGVDGGSTVSEGQAYGILFASIFDEQTLFDGLFLFAKDHYNENGVMDWHIGSPGVRIGSGGATDAEVDMALGLVNACVKVQKNAWPASPAGVNYCVEATNLINAIYTYEVDHAGSAPPGGLPNNQGNELLPGDTWNISELYPQGIINLSYFPPGYFTVFGKFTGNEAAWNAVINRNYQVVDMVQAKPNNCSGLVPNWNNYNGDAQLVSWQTNNYSWWSYDAARFAWRIAVDQAWYGRSEAAETMNEIGGFFSSTGFNNIGEHNMNGQRVGSGPWPFFVANAAAAVWAAPNATAVNCGTATGSLQESAQSAYNRVLTSKDTPNSYYGNAWRLFSMLLMTGNFPNFYEMADGGVTPVPTLPPTQTPHATQPPTATATTSSGGGVCAVDYVIANQWGNGFQANVTITNHSAVPVNGYTLAWTHAPGQVVTNGWNVTIAQSGSAVSASNPASYWNGVIGANGGKVSFGFQGSLAGGSAVAPTYFALNGAACNGAVLPPTATSAPPTQTAVPPTATTILPTQTAVPPTATTIPPTQTAVPPTATSQPPTQTAVPPTATATPPSGVGACTVVYAITNDWGSGFTANVTLTNKSSAALNGWTLAYAFPGNQTISNAWNGTAVQSGKNVSVTNVGWNGSLPPNGVASFGFQASYSGSNSAPTSFTLNGQRCD

SEQ ID NO: 119 - DNA, 3450 bp, Unknown
  Obtained from environmental sample
atgtctcgtaatattaggaaaagttcattcattttttctctgctgacgatcattgtattgattgccagcatgttcctgcaaacccaaacggcacaggcaatcagcactccctggttgagcacctctggcagattcatccgggatccgcagggcaataatgtcgttctgcgaggtgtctcgctggtggatattggtgaggtgaaccttgggcggacgcgcaatgtcagccagctgattaatatggcgaccaatgaagccgatggctggtatgcgcgtgtagtgcgcctgccagtctatccgaatgcgattgatagttcgcctggctggctggcaaacccggatgcttatttcaataaccatctcaacccagctattcagaactgtgtggcgcgccagatctactgcatcatcgactggcactatatcgcggactataacaacagcacgattgacacaaacacacgcgccttctggaactatgtggcgccacgttatgctaatactccgaatgtaatcttcgagttgtacaatgaaccagtcaaccctgataactggtcaacgtggaagcaatgggcgcaaccctgggtcgatatcattcgctctcatgcgccgaacaacttgatcctgatcggtggtccgcgctggtcgcagaatctttcgagcgcggcgagcagtccatttactggcagtaatcttgtgtatgttgctcacatttatcccgaacacggcggacaaagcaactgggattcatggttcggcaatgccgcgaactctgttcccttctttgtcactgagtggggctggatacagggcggcgccaccccaactaatggcacacagtctggctacggtgttccgttcagtaactaccttgaatcaaagggcttgagttggaccgcctgggtctttgatcaatattgggatcctaaaatgtgggatgagaactggaacctgctcggcggtgaaaatttcatgggacaattcacaaaggatttgctcttcgcacaccgcaatgacagtttgcccagtagtaccaacacaccgggtggacccactgccacgcgtacaaatacatcgcctccaccaacagcgacgaatacatcagcgagtggtggagcgctgaaagtccaattggtaacgggcggcaccgagaatagccaacaatctgctttccattataagattttgaacacgggcgccagtgctcaatctaatatttctgtgcgcatttactttacgttggatggttcgcaagcagcctccaaatatgttctcgagaaatattatgaccaatctggagtagcgacgatttccggaccaacccaggtatcaggctcttcttattactttacagtgagctatggtacgactgctcttgccgcaggtgccggttgggaatatcacaccgcactccgcctgagtgattggagcgcaaatttctcaagcgcgaacgattggtggcgtgcaactggctctatgccagccagttacacggactggcccacgatccctgcttatgtgaacggctcgctagtgtggggtagtgcaccaggtggtggaccaaccgctaccaatacgcctgttacaccaactgccacattcacacgtacgaacacacccagtggtccgacttttactcctacacggaccaacacaccgatcacaccgacggccacattcacacgtacgaacacgcccagcgggccaaccttcactttcacacccactgcgactgctacccgtacgaatacccccagtggtccaaccacgcttaaggttcaatataaagctgcggatacaaacgctggtgataaccagatcaagccgcacttcaacattgtcaacacaggtgcaagcgcggtacctctgggtgaattgaagatccgttattggtacacgcgtgaaggaacagtggggcagactttcttctgcgattactctgccattacaggtgggtgtggcaacctcagtggagcgtttgtgcaagtcagcccggctcgaacaggggcagatttctacctggaaatcagcttcaatactgcggcaggatccatcgcggcaggcggtcagagcggagaaattcaagctcgctttgctaagaccgattggtcgaattacaacgagaccggcgattattcctttgaccccaccaagactgccttcgccgattggacaaatgtgactctctatcgcaacggagcgctcgtctggggcactgaacctggtggtggcggacccaccaacacaccaaccgctacgaatacacccggtggaccaactaatacgccaacccgtaccaacactccgatcactccaacctttacaccgactcgaacaaatactccaggcggtccgaccaatacaccaactcgtacaccgactgcaacattgacgccacctcctggaacgcatttggataatccctttgtgggtgcgacgttctatagaaatgtggattacgttgcttcagtcaacgccgcagcggattcacagaccgggacgctcgccgcgcagatgaggttggttgccaattacccgacctttgtctggctggatagcattgacgcggtcaacggcacgaacggttatcccagaagtttggctggtcatttgaatgcagctattactcagggtgccaacgccattggcattgtcgtctatgacctgcccaaccgcgactgctcagccttagcctctaacggcgaattgctcatcgcacaaaacggactcaatcgctacaagaccgaatacattgatgcgatctacaacacgattagccaaccacaatatagtaatttgcgcatcatcatggtcatcgagccagattctctgccgaacctagtcaccaacttgagcttcgccaaatgctctgaagctcaatcaacgggtgcttatgtacagggcgttcaatatgcccttggcacattgcgctcactcaataacacttacgcctatattgatgtggcgcatgcggcgtggctcggctggccttccaactttactccatttgtgaacttgctcaagacagttggcacaggtattcccggcggcaacagcaaagtggatggtttcatcagcaacacagccaactacaacccagtggatgaaccattcatggatgcgaacacgatggttggtggcaatcccgttcgctcactgcaaggttggtacgactggaatgattacattgatgaacaaccctacatccttgctctgcggactgcgctcacgacgggaaccgacgcgtacccaaccagtgtgggcgtgatcattgatacttcgcgcaatggctggggtggtacgaaccgtccgactgctgcaagtacatcaacagtactaagcacctttgtgatggaaagccgaatcgataaacgcatccacaaaggcaattctttggatccactagtgtcgacctgcaggcgcgcgagctccagcttttgttccctttag

SEQ ID NO: 120 - protein, 1149 aa, Unknown
  Obtained from environmental sample
  SIGNAL (1)...(33)
  DOMAIN (44)...(311): Cellulase (glycosyl hydrolase family 5)
  DOMAIN (593)...(677): Cellulose binding domain
  DOMAIN (816)...(1148): Glycosyl hydrolases family 6
  SITE (75)...(78): N-glycosylation site. Prosite id = PS00001
  SITE (148)...(151): N-glycosylation site. Prosite id = PS00001
  SITE (173)...(182): Glycosyl hydrolases family 5 signature. Prosite id = PS00659
  SITE (186)...(189): N-glycosylation site. Prosite id = PS00001
  SITE (221)...(224): N-glycosylation site. Prosite id = PS00001
  SITE (281)...(284): N-glycosylation site. Prosite id = PS00001
  SITE (343)...(346): N-glycosylation site. Prosite id = PS00001
  SITE (371)...(374): N-glycosylation site. Prosite id = PS00001
  SITE (411)...(414): N-glycosylation site. Prosite id = PS00001
  SITE (486)...(489): N-glycosylation site. Prosite id = PS00001
  SITE (515)...(518): N-glycosylation site. Prosite id = PS00001
  SITE (665)...(668): N-glycosylation site. Prosite id = PS00001
  SITE (717)...(720): N-glycosylation site. Prosite id = PS00001
  SITE (737)...(740): N-glycosylation site. Prosite id = PS00001
  SITE (871)...(874): N-glycosylation site. Prosite id = PS00001
  SITE (898)...(914): Glycosyl hydrolases family 6 signature 1. Prosite id = PS00655
  SITE (964)...(967): N-glycosylation site. Prosite id = PS00001
  SITE (995)...(998): N-glycosylation site. Prosite id = PS00001
MSRNIRKSSFIFSLLTIIVLIASMFLQTQTAQAISTPWLSTSGRFIRDPQGNNVVLRGVSLVDIGEVNLGRTRNVSQLINMATNEADGWYARVVRLPVYPNAIDSSPGWLANPDAYFNNHLNPAIQNCVARQIYCIIDWHYIADYNNSTIDTNTRAFWNYVAPRYANTPNVIFELYNEPVNPDNWSTWKQWAQPWVDIIRSHAPNNLILIGGPRWSQNLSSAASSPFTGSNLVYVAHIYPEHGGQSNWDSWFGNAANSVPFFVTEWGWIQGGATPTNGTQSGYGVPFSNYLESKGLSWTAWVFDQYWDPKMWDENWNLLGGENFMGQFTKDLLFAHRNDSLPSSTNTPGGPTATRTNTSPPPTATNTSASGGALKVQLVTGGTENSQQSAFHYKILNTGASAQSNISVRIYFTLDGSQAASKYVLEKYYDQSGVATISGPTQVSGSSYYFTVSYGTTALAAGAGWEYHTALRLSDWSANFSSANDWWRATGSMPASYTDWPTIPAYVNGSLVWGSAPGGGPTATNTPVTPTATFTRTNTPSGPTFTPTRTNTPITPTATFTRTNTPSGPTFTFTPTATATRTNTPSGPTTLKVQYKAADTNAGDNQIKPHFNIVNTGASAVPLGELKIRYWYTREGTVGQTFFCDYSAITGGCGNLSGAFVQVSPARTGADFYLEISFNTAAGSIAAGGQSGEIQARFAKTDWSNYNETGDYSFDPTKTAFADWTNVTLYRNGALVWGTEPGGGGPTNTPTATNTPGGPTNTPTRTNTPITPTFTPTRTNTPGGPTNTPTRTPTATLTPPPGTHLDNPFVGATFYRNVDYVASVNAAADSQTGTLAAQMRLVANYPTFVWLDSIDAVNGTNGYPRSLAGHLNAAITQGANAIGIVVYDLPNRDCSALASNGELLIAQNGLNRYKTEYIDAIYNTISQPQYSNLRIIMVIEPDSLPNLVTNLSFAKCSEAQSTGAYVQGVQYALGTLRSLNNTYAYIDVAHAAWLGWPSNFTPFVNLLKTVGTGIPGGNSKVDGFISNTANYNPVDEPFMDANTMVGGNPVRSLQGWYDWNDYIDEQPYILALRTALTTGTDAYPTSVGVIIDTSRNGWGGTNRPTAASTSTVLSTFVMESRIDKRIHKGNSLDPLVSTCRRASSSFCSL

SEQ ID NO: 121 - DNA, 1158 bp, Unknown
  Obtained from environmental sample
gtgctgatccggctggcggcggccggcgccctgctgctcggcgccgtcttcgtcgcggtgagcccggcggccgcggccaccgcctgcgacgtcacctacaccgccaaccagtggagcaccggcttcaccgccgacgtgcgggtcaccaacaacggcgcgccgatcaacggctgggcggtgacctggacgttcaccggcaaccagcaggtcacctccggctggaacgcgcagctgacccagtccggggccacggtgacggccgcggcgccgtcctacaaccagaccctggccaccggggcctcggccggcttcggcttccaggcgacgtactcgggcagcaacccggcgccggcgtccttcgccctcaacggcgtctcgtgcaacggcgaagccccaccgacgtcggccccaccgacgccgagcacgccgccgacctcgatcccgccgtctcccagcaccccaccgaccacgaccccgccgccggccggctgcaccaccggggtccgctgtgacggcttcgagggcacccaggccgactgggcggtgacctacccggactgctccggcgcgggcaaggcggccttcgacaccgcagtcgcccacggcggcggcacctcgctgcggatcgacggggcggcgggttactgcaaccacgtcttcatgcggaacaccgcgctgatcccggtcggggccaccgcgctgttcgtgcgctactgggtgcggcacaccaccgcactgccggccgcgcacaccacggcggtggcgttgcgggacgccaacgacggccaccgggacctgcgcttcggcggccagaacggcgccctgcaatggaaccgggcgtccgacgacgccacgctgccggaacagagcccggccggggtggcgttgtccgcgccgctgccgacgggcacctggaactgcgtggagttcaaggtcgaccagggcaacggcacgatgcagacctggctcaacggcacatccgtgcccggcctgctgcaggacggcgtgccgacgcacgacatcgacggccagtggctgaacaagacctggcggccggccctgaccgacctgcggctgggctgggagagctacggcgaaggcgcagacaccctctggtacgacgacgtcgccgtgggcaccacccgcgtcggctgctga

SEQ ID NO: 122 - protein, 385 aa, Unknown
  Obtained from environmental sample
  DOMAIN (29)...(127): Cellulose binding domain
  SITE (94)...(97): N-glycosylation site. Prosite id = PS00001
  SITE (320)...(323): N-glycosylation site. Prosite id = PS00001
  SITE (352)...(355): N-glycosylation site. Prosite id = PS00001
MLIRLAAAGALLLGAVFVAVSPAAAATACDVTYTANQWSTGFTADVRVTNNGAPINGWAVTWTFTGNQQVTSGWNAQLTQSGATVTAAAPSYNQTLATGASAGFGFQATYSGSNPAPASFALNGVSCNGEAPPTSAPPTPSTPPTSIPPSPSTPPTTTPPPAGCTTGVRCDGFEGTQADWAVTYPDCSGAGKAAFDTAVAHGGGTSLRIDGAAGYCNHVFMRNTALIPVGATALFVRYWVRHTTALPAAHTTAVALRDANDGHRDLRFGGQNGALQWNRASDDATLPEQSPAGVALSAPLPTGTWNCVEFKVDQGNGTMQTWLNGTSVPGLLQDGVPTHDIDGQWLNKTWRPALTDLRLGWESYGEGADTLWYDDVAVGTTRVGC

SEQ ID NO: 123 - DNA, 1356 bp, Unknown
  Obtained from environmental sample
atgcgcttgaagaccctcgccaccgccacggcggccgccgccgtggtcgccggcaccgccgtgctctggcccggctccgcctccgccgccgagtcacccttctatgtcgatccgcagaccggcgccgcccgctgggtcgccgccaacccgggcgactccaaggccgcggtgatccgcgaccggatcgccagcgtcccgcagggccgctggtacacccagaacaacaccgccacggtcgccgccgaggtggactccttcgtgggcgccgccgccgcggccggcaagacgccgatcatggtcgtctacaacatccccaaccgcgactgcagcggcgccagctccggtggcctggccaaccacaccgtctaccggcagtggatcgaccaggtggccgccgggctcaagggccgcgcggccgcgatcatcctggaaccggacgtgttgccgatcatgtcgagctgcatgtcgtccgcgcagcaggaagaggtctacgcctcgatggcgtacgcgggcaagaagctcaaggccgcctcgtccgcggccaaggtctacttcgacgccgggcactcggcctggctgtccccgggggacatggccgcccggctggtccgcgccgacatcgccaacagcgccgacggcatctcggtcaacgtctccaactaccgcaccaccgccgagtcgaccacctatgtccgcaacgtgctggccgcggtcggcgtctcccggctgcgcggcgtgatcgacaccagccgcaacggcaacggcccggccggcagcgagtggtgtgacccgggcggacgggcgatcggcattcccagcacgaacgcggtgtccgatgcgatcctggacgcgtacctgtggatcaagctgcccggcgaagccgacggctgcatcgccggggccggtcagttcgtcccgcagcgcgcctacgacctggccgtcgcggccgggccgtacacaccgccgccggcgaccaccccaccgaccaccaccccgccggccaccaccccgccggtcacgccgccggtgaccaccccgccgccggccggtggctgctcggtgtcctacacggcgaactcctggtcgaacggcttcaccgccgatgtccggatcaccaaccgcggcgccgcgctgagctcctggacgctgaccttcaccgtgcccgccaacgtcaccctgagcagcggctggagcggcacctggagccagtccggcagcacgatcacggtccggaacgcggcctggaacggcgcgctcggcagcggcgccaccaccagcaccggcttccaggcgaccttcaccggtgcggccccggccagcccgaccggcttcgcgctgaacggcacgccgtgctga

SEQ ID NO: 124 - protein, 451 aa, Unknown
  Obtained from environmental sample
  SIGNAL (1)...(29)
  DOMAIN (36)...(311): Glycosyl hydrolases family 6
  DOMAIN (352)...(451): Cellulose binding domain
  SITE (75)...(78): N-glycosylation site. Prosite id = PS00001
  SITE (101)...(117): Glycosyl hydrolases family 6 signature 1. Prosite id = PS00655
  SITE (120)...(123): N-glycosylation site. Prosite id = PS00001
  SITE (220)...(223): N-glycosylation site. Prosite id = PS00001
MRLKTLATATAAAAVVAGTAVLWPGSASAAESPFYVDPQTGAARWVAANPGDSKAAVIRDRIASVPQGRWYTQNNTATVAAEVDSFVGAAAAAGKTPIMVVYNIPNRDCSGASSGGLANHTVYRQWIDQVAAGLKGRAAAIILEPDVLPIMSSCMSSAQQEEVYASMAYAGKKLKAASSAAKVYFDAGHSAWLSPGDMAARLVRADIANSADGISVNVSNYRTTAESTTYVRNVLAAVGVSRLRGVIDTSRNGNGPAGSEWCDPGGRAIGIPSTNAVSDAILDAYLWIKLPGEADGCIAGAGQFVPQRAYDLAVAAGPYTPPPATTPPTTTPPATTPPVTPPVTTPPPAGGCSVSYTANSWSNGFTADVRITNRGAALSSWTLTFTVPANVTLSSGWSGTWSQSGSTITVRNAAWNGALGSGATTSTGFQATFTGAAPASPTGFALNGTPC

SEQ ID NO: 125 - DNA, 2370 bp, Unknown
  Obtained from environmental sample
atgttcaagcgcaatacggttcgtgtgggctgttttatcgcggtcaccgcgatttgtgcaatgctgcttttccatgtgccatccgttgtttcggcgcgtaccaacgccgccggtgcgggctactggcacacgagcggcaatcagatcctcgacgccaacaatcaacctgtccgcatcgcgggcatcaactggttcggtatggaaacgagcaactatgcgccgcacggtttgtggacgcgtgattacaaatccatgctcgaccagatcaaacaacagggctacaacacggtccgcttgccgtattcgaaccaactgtttgacgcgggcagcgttccgaatggcattgacttttcgaatggcaaaaacgccgaccttaaagggttgaatggtctgcaaatcatggacaagctggtggcatacgcggggcaaaagggcttgcgcatcgtgcttgaccgccaccgccccgacagcggcggtcagtctgaactgtggtacacgagccggtattccgagcagcgttggattaacgattggaaaatgcttgccgggcgctatgccaacaatcccacggtcatcggcgcagacctgcacaacgagccgcacggtcccgcgtgttggggctgcggcgacactgccaccgactggcgtctcgccgccgagcgcgcagggaatgcgattcacacggtcaattccaactggctgatatttgtcgaaggcatcggctgtgtgaatggtgattgcagctggtggggtggtcagttgaaaaacgcgggtcagtatcccgtacgtctgaccgtcgcgaaccgactcgtctattccgctcacgattatcccgcttcactttacccgcagacgtggttcagcgcccctaactatccgaacaatttgccgggggtgtgggacaattattggggctatctccacaaacagaatatcgcgccggtgcttgtcggggaatttggctcgaaacttcaaacgacctctgaccgccagtggctcaacaagctgacgcaatatctcggcagcaacggcatcagctggacgttctggagttggaatccgaattcgggcgacacgggcggcattctgaatgatgattggacgacgatcaacaccgacaaacaatcgtatctcgccggcggcacggatgcgacaggtgtaacgcaccagtctatcctgttcccgctcgatgtgggcggcacaccgcagccatccgcaacatttacgcggaccagtacccggacccgcacgccgaccgcgtgcggcaactgcccgaccgcaacgccgacgcggacgcgcactttgaccgcgacgtcaacgcgcaccaatacacccagcccgaacaatggactcaagctgcaataccgcgtcggtgatggcacatcggcaaacgacaatcaaatcaagccccaattccgaattgtcaacaacggcgcatcgaacgtgccattgagcgagctcgaaatccgatactggtacacttccgaaggcaatcaagcgcaatcctactggtgcgactatgctacgctcaattgcgccaacatcacgggcagctttgtcaaattgcaaaacgcggtcaatggcgcaaatggatacttgcggttgaaattcaccgggggacaggtgaatgccaattccaacacgggtgagattcaaaatcgtttcaacaagagcgattggtccaattacagcgagggcgacgattattcatacgacccgaccaaaacctcgttcaccgattggaacaaggtgacgctctatcgcaatggcgcgctggtctggggcattgaacccacaggcacaaagtcagtgactgccacgcccacgcgcacgcgcaccaatgtgccggggaaaaactctccaactccaacacccacgctgacggcaatgccaactgaagctcccgcggtcagtatgcatgttcaatatcgtaatggcgaaaatcccgccaaacccaagaacgcgcatctccgcccgcagtttcgcctcatcaatgacggtggtacgcaagtctcgctcaaggacgtgacgattcgttactggttcacgaggcagggcgaatccaaatacaagttttcgtgcgaggcggccgcgctggactgtgccaacattcgcggcaaggtcgtcaatctgccctcggcgcgacccggcgcgaatgcctatctcgaagtgcgcttccgccccgcagctgggatgcttgcacccggcgccaatacgggcgagatcgtcacgcacctggtcaaaaaggacaagtcaaagcataacgagaatcgagactattcgtttaacaagacccagtttgactttgccgaccgcgccgagattacggtctatcggaatggtgcgctcgtcggcggtatcgagccgtaa

SEQ ID NO: 126 - protein, 789 aa, Unknown
  Obtained from environmental sample
  SIGNAL (1)...(32)
  DOMAIN (47)...(360): Cellulase (glycosyl hydrolase family 5)
  DOMAIN (453)...(536): Cellulose binding domain
  DOMAIN (641)...(725): Cellulose binding domain
  SITE (521)...(524): N-glycosylation site. Prosite id = PS00001
  SITE (564)...(567): N-glycosylation site. Prosite id = PS00001
  SITE (570)...(573): N-glycosylation site. Prosite id = PS00001
  SITE (774)...(777): N-glycosylation site. Prosite id = PS00001
MFKRNTVRVGCFIAVTAICAMLLFHVPSVVSARTNAAGAGYWHTSGNQILDANNQPVRIAGINWFGMETSNYAPHGLWTRDYKSMLDQIKQQGYNTVRLPYSNQLFDAGSVPNGIDFSNGKNADLKGLNGLQIMDKLVAYAGQKGLRIVLDRHRPDSGGQSELWYTSRYSEQRWINDWKMLAGRYANNPTVIGADLHNEPHGPACWGCGDTATDWRLAAERAGNAIHTVNSNWLIFVEGIGCVNGDCSWWGGQLKNAGQYPVRLTVANRLVYSAHDYPASLYPQTWFSAPNYPNNLPGVWDNYWGYLHKQNIAPVLVGEFGSKLQTTSDRQWLNKLTQYLGSNGISWTFWSWNPNSGDTGGILNDDWTTINTDKQSYLAGGTDATGVTHQSILFPLDVGGTPQPSATFTRTSTRTRTPTACGNCPTATPTRTRTLTATSTRTNTPSPNNGLKLQYRVGDGTSANDNQIKPQFRIVNNGASNVPLSELEIRYWYTSEGNQAQSYWCDYATLNCANITGSFVKLQNAVNGANGYLRLKFTGGQVNANSNTGEIQNRFNKSDWSNYSEGDDYSYDPTKTSFTDWNKVTLYRNGALVWGIEPTGTKSVTATPTRTRTNVPGKNSPTPTPTLTAMPTEAPAVSMHVQYRNGENPAKPKNAHLRPQFRLINDGGTQVSLKDVTIRYWFTRQGESKYKFSCEAAALDCANIRGKVVNLPSARPGANAYLEVRFRPAAGMLAPGANTGEIVTHLVKKDKSKHNENRDYSFNKTQFDFADRAEITVYRNGALVGGIEP

SEQ ID NO: 127 - DNA, 1425 bp, Unknown
  Obtained from environmental sample
gtgtcaggagaaccgcacgtgtcccttcgtctctcgcgcccccgccgtcgtacagccatcctcgccgcggtcgccgcgtgcacggtcaccgcgggtgcctggctcgcaaccggcaccgcctcggccggcacgctgtccggcaccctctaccgcgatcccaactcgtcagcgacacgctgggtggcggccaacccgaacgactctcgtgcatcagccatccgcgacaagatagccagccagccggcggcccgatggctggccaatttcaacatctccaccatccagtccgaggtttcgacctacatcggtgcggccaacagcgccaatcaggtcccggtcttcgccgtgtacatgatccccaaccgcgactgcggtggggccagcgccggtggcgcgcccgacctgaaccagtaccagacctgggtctcggcgttcgcccagggactcggcaacaggctggtcatcatcatcctcgagaccgactcgttggcgctcaccacctgcctggacgcgaacgccctggccgcccgtaaccaggccatcagcaccgcggtgcagaccatcaagtcgcgcaacgcgaacgccaaggtgtacctcgacggcggacactccacctggaacagcgcgtcggacacggccaaccgccttcggaatgccggagtccagttcgctgacggcttcttcaccaacgtctcgaacttcaactcgaccagtagcgaggtgaacttcggccggtcggtcatttcggccctgtcctcgctcggcatcagtggcaagcgccagatcatcgacaccagccgtaacggcggcgccagtggtgactggtgcgcagacgacaacactgaccgccggctcggacaatggccgacactgaacaccggtgatggcaatgtggacggctacctctgggtcaagccgcccggcgaggccgacggttgcgccttccaggccggcagcttccagccgcagctcgcgttcagcctcactcagggaataggcaacccgccgacctcggccccgccgaccaccgccgtgcctaccaccacgcggccgccgacctcggcgccgccgaccaccacgcggccgccgacctcggccccgccgaccaccacaccaccgcccactacgacgggcgcctgctccgccaccatgtcgatcaccaactcgtggcccggcggtttccaggcgaatgtcaccgtggcggccggcagcgcggcgatctccgggtggactgtccggtggaccctgtccagcggtcagaccatcacccaactctggaatggggcccagacggtgagcgggtcagccgtgacggtcaggaatctgtcctacaacggctcgctggcagccggtgcgaacacctcgttcgggttcaccgctaacggcagcgcttcgacgcccgcgaccacctgcacatcgccgtag

SEQ ID NO: 128 - protein, 474 aa, Unknown
  Obtained from environmental sample
  SIGNAL (1)...(42)
  DOMAIN (51)...(327): Glycosyl hydrolases family 6
  DOMAIN (380)...(471): Cellulose binding domain
  SITE (54)...(57): N-glycosylation site. Prosite id = PS00001
  SITE (67)...(70): N-glycosylation site. Prosite id = PS00001
  SITE (91)...(94): N-glycosylation site. Prosite id = PS00001
  SITE (233)...(236): N-glycosylation site. Prosite id = PS00001
  SITE (238)...(241): N-glycosylation site. Prosite id = PS00001
  SITE (403)...(406): N-glycosylation site. Prosite id = PS00001
  SITE (447)...(450): N-glycosylation site. Prosite id = PS00001
  SITE (451)...(454): N-glycosylation site. Prosite id = PS00001
  SITE (459)...(462): N-glycosylation site. Prosite id = PS00001
  SITE (468)...(471): N-glycosylation site. Prosite id = PS00001
MSGEPHVSLRLSRPRRRTAILAAVAACTVTAGAWLATGTASAGTLSGTLYRDPNSSATRWVAANPNDSRASAIRDKIASQPAARWLANFNISTIQSEVSTYIGAANSANQVPVFAVYMIPNRDCGGASAGGAPDLNQYQTWVSAFAQGLGNRLVIIILETDSLALTTCLDANALAARNQAISTAVQTIKSRNANAKVYLDGGHSTWNSASDTANRLRNAGVQFADGFFTNVSNFNSTSSEVNFGRSVISALSSLGISGKRQIIDTSRNGGASGDWCADDNTDRRLGQWPTLNTGDGNVDGYLWVKPPGEADGCAFQAGSFQPQLAFSLTQGIGNPPTSAPPTTAVPTTTRPPTSAPPTTTRPPTSAPPTTTPPPTTTGACSATMSITNSWPGGFQANVTVAAGSAAISGWTVRWTLSSGQTITQLWNGAQTVSGSAVTVRNLSYNGSLAAGANTSFGFTANGSASTPATTCTSP

SEQ ID NO: 129 - DNA, 1080 bp, Unknown
  Obtained from environmental sample
atgaaacggtcactatgtttagttcttgtcctactagtgattctttcagcttgtgttcaaaattacgcaacaccaacatctgctcccaccacccaatccacggagactccaatgccaccaactactacatctcagcctgatccaacatccacacccagtacaaatgtcaaacttcagcggggcgtgaacatgggtaatatgctcgaagcgccgaacgaaggcgattggggactctatgtacaggaagaatattttgacttaatcaaagacgcaggctttgactttgtccgtttgcccgtgcggtggagcacacatgcggaagccgaatcgccctacacaattgattcaactttctttgcacgcgtagatgaagtagtcaactgggctttggagcgaaatctcaggatcatcgttgacttccatcactacgaagaaatgatgaccgatccgtggattcacagagatcgttatatcggtgtttggaaacaggtcgctgagcattaccaggattatccatcaaatgttttatttgaattacttaacgaacctaacaatactctgaatgcccagctttggaatcaatatttgactgaagcattggcagttgtaagagagtcaaacccaactcgtgatgtagtaatcggccctgtcaattggaatgcttatgattggctctccacactcgatgtgccggatgatgagcatctgattgttacatttcattactatttgccgttccattttacgcatcaaggcgcaaaatgggttggagatgatgctcaaaattggctaggcactgaatggggaagtgacgaggaaaaagcggaagtcacgggtcatttcgatgcggtggctgattgggcacagcgacatggaaatgttcgcatattgatgggagagtttggggcgtattcaaaaggtccgcaagactcacgcgtccgctggacggagtttgtgaggggcgcagcggaaagccacgggtttgcgtgggcttattgggaattcgcttcaggtttcggggtgtatgacccggaagctaaagtctggagagatgatttgttgcaggcgttgattccgtaa

SEQ ID NO: 130 - protein, 359 aa, Unknown
  Obtained from environmental sample
  SIGNAL (1)...(23)
  DOMAIN (65)...(343): Cellulase (glycosyl hydrolase family 5)
  SITE (177)...(186): Glycosyl hydrolases family 5 signature. Prosite id = PS00659
  SITE (186)...(189): N-glycosylation site. Prosite id = PS00001
MKRSLCLVLVLLVILSACVQNYATPTSAPTTQSTETPMPPTTTSQPDPTSTPSTNVKLQRGVNMGNMLEAPNEGDWGLYVQEEYFDLIKDAGFDFVRLPVRWSTHAEAESPYTIDSTFFARVDEVVNWALERNLRIIVDFHHYEEMMTDPWIHRDRYIGVWKQVAEHYQDYPSNVLFELLNEPNNTLNAQLWNQYLTEALAVVRESNPTRDVVIGPVNWNAYDWLSTLDVPDDEHLIVTFHYYLPFHFTHQGAKWVGDDAQNWLGTEWGSDEEKAEVTGHFDAVADWAQRHGNVRILMGEFGAYSKGPQDSRVRWTEFVRGAAESHGFAWAYWEFASGFGVYDPEAKVWRDDLLQALIP

SEQ ID NO: 131 - DNA, 1116 bp, Unknown
  Obtained from environmental sample
gtgatgaaagggtttcgctggtgtgtgatggcgatggtggtgatggcggcgacgaacgttcgcgccgcctgcacctggcctgcatgggagcagtttaaaaaggactatatcagcgaaggcgggcgcgtcattgatcccagtgacgcgcgcaaaatcagtacctcggaagggcaaagctacgcgctgttctttgccctcgcggcgaacgatcgccagacctttgatcggctgctgggctggacacgcgacaacctcgcgcagggcgatctgagccagcatctccccgcctggctgtggggaatgaaagaaaaagagaaagagacctgggcggtgatcgacagcaattccgcctcggatgccgatatctggattgcctggtcgctgctggaagcggggcgtttgtggaaagcgccggagtacacggccaccgggaaagcgctgctcaggcgcattgcccgtgaagaggtggtcaaggtgccgggcctggggctgatgctgctgcccggtaaagtcggctttgccgaagagaaatcctggcgcttcaacccgagctatctcccgccgcagctggcgaactatttcacccgttttggcgcaccctggaccacgcttcgcgaaaccaatttgcggctgctgctggaaaccgcgccaaaaggcttctcacccgactgggtgcagtatcaaaaaaataagggctggcaactgaagccagaaaaaacgtttatcggcagctacgacgcgattcgcgtctatctctgggcgggcatgttgcacgaccgggacccgcagaaagcgcggctgctggcacgttttaaacccatggcgacgcttacaacgaaaaaaggcgtaccccctgagaaagtcgatgtcgccagcggtaaaaccacgggcaatggcccggtcggtttctccgcctcactgctgccgtttttacaaaaccgcgatgcacaagcggtacaacgtcagcgtgtcgccgaccattttcccggtaatgacgcctattacagctacgtactgaccctgtttggacaaggatgggatcagcatcgttttcgtttcaccgcaaagggtgaattacaccctgactggggccaggaatgcgcaagttctcattaa

SEQ ID NO: 132 - protein, 371 aa, Unknown
  Obtained from environmental sample
  SIGNAL (1)...(22)
  DOMAIN (3)...(349): Glycosyl hydrolases family 8
MMKGFRWCVMAMVVMAATNVRAACTWPAWEQFKKDYISEGGRVIDPSDARKISTSEGQSYALFFALAANDRQTFDRLLGWTRDNLAQGDLSQHLPAWLWGMKEKEKETWAVIDSNSASDADIWIAWSLLEAGRLWKAPEYTATGKALLRRIAREEVVKVPGLGLMLLPGKVGFAEEKSWRFNPSYLPPQLANYFTRFGAPWTTLRETNLRLLLETAPKGFSPDWVQYQKNKGWQLKPEKTFIGSYDAIRVYLWAGMLHDRDPQKARLLARFKPMATLTTKKGVPPEKVDVASGKTTGNGPVGFSASLLPFLQNRDAQAVQRQRVADHFPGNDAYYSYVLTLFGQGWDQHRFRFTAKGELHPDWGQECASSH

SEQ ID NO: 133 - DNA, 1335 bp, Unknown
  Obtained from environmental sample
gtgccgaccgggttgagggccaagccctgcctcacgcgctggctcgcggccagcgcctgcgcgctcgcgccgctgctgctcggcgcgcccgcgtccgcgcttgccgcgacggcgaacgcgaacgccaaaacgcctgctgcgaagacgacgtcggctgccgcgccgcaagcgcctgcctgcgcgtggtccgactggaccgcgttcaagggcgcgctgctgtccgccgacggacgcgtgatcgacgccagttcgccgcgtcaggtgacggtctccgaaggccagtcgtacgcgctcttcttcgcgctcgtcgcgaacgaccgcgcggccttcgacaagatcctcgcgtggaccgagaacaatctcgcccggggcgatctcgcggcgcatttgcccgcgtggatctgggggcgcaccgacatcgacgaaaacggcgcgccggtcgtggcttcggctgcgtcggccgcgtcgtccagccccgctacgcagacgcaaaccggcacgtggggcgtgatcgacaccaactccgccagcgacgccgatctctggatcgcctacacgctgctcgaagcgggccgcctctggaacgtgcgccgctacacggcgatcggcacggtgatggcgcgcaacgtcctgcgccgcgagacggccgcgctgcccggcctcggccgcacggtgctgcccggcccggtcggcttcacgctcgacaagaacacgtggcgtctgaacccgagctatgtgccgctgcaggtcatgcgccgcttcacgctcgcgatgcccgagaaagaacggcccgagtggaagtcgctgctcggcagttcgtcgaagctcgtcaacggcaccgcgcccaagggcttttcgcccgactgggtcgtctaccgcgcgcggggcaacaagggcgatttcggccctgacgaacccacgcacgccgaaagcgcctataacgcgatccgcgtctatctgtgggcgggcatgctcgcttacgacgacccggcgcgcagcgcgacgctcgcgaccttcgcgccgctctcggccttcgtggccgcgcacggctttccgcccgagcgcgtcaacacgcagaccggcgaacccggcccgaacgagggcaacggcggcttttcggcggcggtcgcgccgtatctgtcggcactcggccgcaccgatctgtccgatgcgcaggttcaacgcagccgcacgctcgcgcaaaaatcgccgcccggctattacagcagcgtgctgatgctgttcggcctcggctatctgcaaggcctttatcgcttcgatgcgcaaggccgcgtaattcccgcatggacggctcaatgcccggcagcacgatga

SEQ ID NO: 134 - protein, 444 aa, Unknown
  Obtained from environmental sample
  SIGNAL (1)...(35)
  DOMAIN (38)...(422): Glycosyl hydrolases family 8
  SITE (282)...(285): N-glycosylation site. Prosite id = PS00001
MPTGLRAKPCLTRWLAASACALAPLLLGAPASALAATANANAKTPAAKTTSAAAPQAPACAWSDWTAFKGALLSADGRVIDASSPRQVTVSEGQSYALFFALVANDRAAFDKILAWTENNLARGDLAAHLPAWIWGRTDIDENGAPVVASAASAASSSPATQTQTGTWGVIDTNSASDADLWIAYTLLEAGRLWNVRRYTAIGTVMARNVLRRETAALPGLGRTVLPGPVGFTLDKNTWRLNPSYVPLQVMRRFTLAMPEKERPEWKSLLGSSSKLVNGTAPKGFSPDWVVYRARGNKGDFGPDEPTHAESAYNAIRVYLWAGMLAYDDPARSATLATFAPLSAFVAAHGFPPERVNTQTGEPGPNEGNGGFSAAVAPYLSALGRTDLSDAQVQRSRTLAQKSPPGYYSSVLMLFGLGYLQGLYRFDAQGRVIPAWTAQCPAAR

SEQ ID NO: 135 - DNA, 1782 bp, Unknown
  Obtained from environmental sample
gtgtcaatgataacgccaaaaacaaagtcttatggcttggcagccatgctcagccttggtttggcagttgccaaccaaaacgctaatgcaggctgcgtttataaaattactaatgattggggggcgggcctaaccggcgaaatcgtcatcaccaacagcggcagctctgccgtgaatggctggaatattggttggcagtacgccaccaatcgcatcaccagttcatggaatgtaaaccttagcggaagtaatccatattctgcctccaacatcagttggaatggaaatttacaaccaggccaaagtgccagctttggttttcaagtggataagcgcggtggttccgccgaagtacccactattaccggttcggtctgctcgggcacagtgaccagttcggccgccccttcaagcacgccggttcgctccagcagttcaactgcggtggcgagtagttccaacaataataacggcggccagcaatgtaattggtatggaacaatcattccgctgtgcgtaaataccgcgagtggctggggttgggaaaataaccaaacctgcgtttcccgttcggtttgcaccacgattgttaacggatcatcttcagcaacaccgtcttcaacgccaattgtttcatccagttcaagatcatcctcgtcagtaccgattgttccttccagttcatcgccttccagctcctcatcgtcaaataacaataaccagggcattgcaccattggttgtgcaaggcaataaagtgaccgccaatggccagcccgcgaatttggctggcatgagtttgttctggagcaacaccggctggggtggcgagaagtattacaactcgcaagccgttgcctggttgaagtctgactggaaagccaatctggttcgcgccgccatgggggttgatgaagccggtggttatctcaccgactcaaccaacaaaacacgtgttaccgcagtggttgatgcagcaattgccaacaatatgtatgtgattatcgattggcacacgcatcacgctgaagataacaaagcggccgccatcgccttctttaaagaaatggcgaccaaatacggcagctataacaatgtgatttacgaggtgtacaacgagccactgcaagtttcctggagcagtgtgatcaagccgtatgcgactgatgtgatccgtgagattcgcgcaatcgatccggacaacctgatcattgtcggtaccccaagctggtcgcaggatgtggatgtcgcggcgaatgacccgatcactgcgtacaccaacatcgcttacaccttgcacttctactcaggtacccataaacaattcctgcgcgacaaagcacaaacggcattgagcaaaggtattgcgttattcgtgaccgagtggggttcagtgaatgccgacggtaatggcgcagtggacaccgctgaaaccaacgcctggttaagcttcctgaaaaccaacggtatcagccacgcgaattgggcattgaacgataaagccgaaggttcatctgcattaactcccggagcaagtgctaacggaggttggagcagtggtcaattgaccgcttcaggatcattggtacgcaacgcgattatcaccaataacaataacggcaacaccagctctgtcgcgactacttcaacatcttccagtgttagctcgattaataccaacccgagcaccattgcaccggacaatgcgaagattcgctacaacggtcgcgtcagcctcaactccactgctgcgctttacgattgggcaaatacccaaatcgaa

SEQ ID NO: 136 - protein, 594 aa, Unknown
  Obtained from environmental sample
  DOMAIN (30)...(126): Cellulose binding domain
  DOMAIN (250)...(505): Cellulase (glycosyl hydrolase family 5)
  SITE (80)...(83): N-glycosylation site. Prosite id = PS00001
  SITE (91)...(94): N-glycosylation site. Prosite id = PS00001
  SITE (94)...(107): Cellulose-binding domain, bacterial type. Prosite id = PS00561
  SITE (186)...(189): N-glycosylation site. Prosite id = PS00001
  SITE (201)...(204): N-glycosylation site. Prosite id = PS00001
  SITE (319)...(322): N-glycosylation site. Prosite id = PS00001
  SITE (371)...(380): Glycosyl hydrolases family 5 signature. Prosite id = PS00659
  SITE (549)...(552): N-glycosylation site. Prosite id = PS00001
  SITE (588)...(591): N-glycosylation site. Prosite id = PS00001
MSMITPKTKSYGLAAMLSLGLAVANQNANAGCVYKITNDWGAGLTGEIVITNSGSSAVNGWNIGWQYATNRITSSWNVNLSGSNPYSASNISWNGNLQPGQSASFGFQVDKRGGSAEVPTITGSVCSGTVTSSAAPSSTPVRSSSSTAVASSSNNNNGGQQCNWYGTIIPLCVNTASGWGWENNQTCVSRSVCTTIVNGSSSATPSSTPIVSSSSRSSSSVPIVPSSSSPSSSSSSNNNNQGIAPLVVQGNKVTANGQPANLAGMSLFWSNTGWGGEKYYNSQAVAWLKSDWKANLVRAAMGVDEAGGYLTDSTNKTRVTAVVDAAIANNMYVIIDWHTHHAEDNKAAAIAFFKEMATKYGSYNNVIYEVYNEPLQVSWSSVIKPYATDVIREIRAIDPDNLIIVGTPSWSQDVDVAANDPITAYTNIAYTLHFYSGTHKQFLRDKAQTALSKGIALFVTEWGSVNADGNGAVDTAETNAWLSFLKTNGISHANWALNDKAEGSSALTPGASANGGWSSGQLTASGSLVRNAIITNNNNGNTSSVATTSTSSSVSSINTNPSTIAPDNAKIRYNGRVSLNSTAALYDWANTQIE

SEQ ID NO: 137 - DNA, 1119 bp, Unknown
  Obtained from environmental sample
atgaaatttccgcttcaattccttcctttgattttttttcgtgttctgcgtttatgtttaattcccctactggtttttaccagtaatttcagtgtggcagacgatgcctggcaaaatagtaatggctggtggaatgaaaccgatattcccgcctttgataaaagcaaaattgaaaagcaacttttattagtaaaagtgcagggcaataaatttgtggattcaaccggcaagacgctggtgtttcgcggactgaatattgccgaccccgacaaaattgcgcgcgataaacgtttcaccaaaaaacattttgaagtgattaaatcctggggcgcgaatgttatccgtgtgccggtgcatccatcagcctggcgcaagcacggcaaaaaagcctatctcgccatgctcgaccaggtggtggtttgggcgaatgaattgggcatgtatgtgatcctcgattggcactccatcggcaacctcaaatcgcaaatgttccagaataattcctactacaccgataagcccgagaccttcgatttttggcgcactgtctccgagcgctacgccggtatccacgcggtggccttctacgaaatttttaatgagccaacggtattcagcggccgtttgggcatggtgagttgggcggagtggaaagcgattaacgaagaaattatcaccgttatccaggcgcacaatccggcggcgatttcactcgtggccggttttaattgggcatacgatttaaccccggtcgccaccgcgcctatcgagcgcaacaatgtggcctatgtaagccatccctatccgatgaaagtgggtgcgccctacgaaaaaaattgggagcgcgattttgggtttatcgccgataagtatccggtcttcgccaccgaaatcggctaccagttagcgacagataaaggcgcgcacatcccggtgattgacgatggccagtacggcaagcgcatcactgattatttcaatagcaaaggtattagctgggtgggctgggtgtttgacccggattggtcgccgcaaatgtttaccgactacaaaacctataagcctactatgcagggccagcatttccgcgacgttatgctgcgcgataataaaaaataa

SEQ ID NO: 138 - protein, 372 aa, Unknown
  Obtained from environmental sample
  SIGNAL (1)...(33)
  DOMAIN (69)...(346): Cellulase (glycosyl hydrolase family 5)
  SITE (29)...(32): N-glycosylation site. Prosite id = PS00001
  SITE (45)...(48): N-glycosylation site. Prosite id = PS00001
  SITE (168)...(171): N-glycosylation site. Prosite id = PS00001
MKFPLQFLPLIFFRVLRLCLIPLLVFTSNFSVADDAWQNSNGWWNETDIPAFDKSKIEKQLLLVKVQGNKFVDSTGKTLVFRGLNIADPDKIARDKRFTKKHFEVIKSWGANVIRVPVHPSAWRKHGKKAYLAMLDQVVVWANELGMYVILDWHSIGNLKSQMFQNNSYYTDKPETFDFWRTVSERYAGIHAVAFYEIFNEPTVFSGRLGMVSWAEWKAINEEIITVIQAHNPAAISLVAGFNWAYDLTPVATAPIERNNVAYVSHPYPMKVGAPYEKNWERDFGFIADKYPVFATEIGYQLATDKGAHIPVIDDGQYGKRITDYFNSKGISWVGWVFDPDWSPQMFTDYKTYKPTMQGQHFRDVMLRDNKK

SEQ ID NO: 139 - DNA, 1773 bp, Unknown
  Obtained from environmental sample
atgcctttatgtaccacaaaacatttacttccggctttggtgctggttactgcatccagttttatgctgggctgcggtaatagcactacacctgcagaaaaatcaaccgcatcatccgcagtggttggcaatattaaattgaatcagcttggttttttgcctgagtcagccaagtgggcggtgattcctgatgtggctgcaactcaattcaaggtgattgatacagcaactaatgccgaggtttacagcggcaacttaagtgcagccgctaattgggacgcagcagaagagaatgtaaaacttgcggatttttccagtgtaaaaacaccgggtaattatcttgtgcgggttgagggcgttaaggattcctatccatttgcgattggtgcagatgtttaccaagcgctaaatgctgctagcatcaaagcgttttattttaatcgcaacagcgcggagttattacctgagcacgctggtgtgtatgcgcgtccgctcggtcatcctgataccaatgtattgattcatccttcagcagcaagcgacgcgcgtcctgcgggagctgtgatctccagtcctaaaggttggtacgacgccggtgattacaacaaatatatcgttaactccgggatcgcgacttattcactgcttgctgcttacgaacattttccggaaatatttaataaccagaatttaaatattcctgaaagcggcgatgcaattcctgatttgctcaatgaaaccctgtggaatcttgagtggatgttgacgatgcaagatcccaacgacggcggtgtttatcacaaacttaccaacaaacgatttgatggcacggtgatgccgcatgaggcaactaccgagcgctacgtcgtacaaaaaaccacggcagcagcattggattttgcagcggtaatggcagcagcgagccgggtgcttgcgcaatatgaaaatcaattgccgggcatgtctgtaaaaatgttagctgcggcagaatctgcctgggcgtgggctgcggctaatccggcagtaatttacaaacagccggacgatatcaaaaccggtgaatatggtgatgcaaatctcgccgacgaatttgcctgggcggctgctgagttgtacatcactaccaaaaaagacagctactacaacgcaatgaaaccggaagagacaacggcaacagttccatcatggggtgatgtacgcgggttgggttggatctcgctcgcgcatcatcgcgatcaattgacagcaattgcggatcaacaattaattgcgaaccgcattgatggtttggcggccagtttgcaatcggcgtgggcggcgtctgcctatcgcgttaccatgcagaaaaatgatttcaagtggggcagtaattcggttggattagggcaggcgatgattcttgtgcaagcctatcaattgaatggcaagcgcgagtatctggatgcggcgcaggcaatgctggattatgttcttggccgcaacgcgaccgacatgtcattcgtcaccggttatggcgccaaggcaaccatgcatccacaccatcgcccgtcgggtgctgataaagtggcttatcctgttccgggttttcttgccggtggtccgcaggcggggcaacaggataaagacgattgtgaagtcgcctatccatcgcccatcactgccaagtcttatctggatcactactgcagttacgccagcaacgaagtggcgattaactggaatgcaccattagtgtacgtttctgccgccatccaggcgctgacaccaaagtaa

SEQ ID NO: 140 - protein, 590 aa, Unknown
  Obtained from environmental sample
  DOMAIN (41)...(124): N-terminal ig-like domain of cellulase
  DOMAIN (132)...(584): Glycosyl hydrolase family 9
  SITE (27)...(30): N-glycosylation site. Prosite id = PS00001
  SITE (86)...(89): N-glycosylation site. Prosite id = PS00001
  SITE (248)...(251): N-glycosylation site. Prosite id = PS00001
  SITE (501)...(504): N-glycosylation site. Prosite id = PS00001
  SITE (506)...(522): Glycosyl hydrolases family 9 active sites signature 1. Prosite id = PS00592
  SITE (565)...(583): Glycosyl hydrolases family 9 active sites signature 2. Prosite id = PS00698
MPLCTTKHLLPALVLVTASSFMLGCGNSTTPAEKSTASSAVVGNIKLNQLGFLPESAKWAVIPDVAATQFKVIDTATNAEVYSGNLSAAANWDAAEENVKLADFSSVKTPGNYLVRVEGVKDSYPFAIGADVYQALNAASIKAFYFNRNSAELLPEHAGVYARPLGHPDTNVLIHPSAASDARPAGAVISSPKGWYDAGDYNKYIVNSGIATYSLLAAYEHFPEIFNNQNLNIPESGDAIPDLLNETLWNLEWMLTMQDPNDGGVYHKLTNKRFDGTVMPHEATTERYVVQKTTAAALDFAAVMAAASRVLAQYENQLPGMSVKMLAAAESAWAWAAANPAVIYKQPDDIKTGEYGDANLADEFAWAAAELYITTKKDSYYNAMKPEETTATVPSWGDVRGLGWISLAHHRDQLTAIADQQLIANRIDGLAASLQSAWAASAYRVTMQKNDFKWGSNSVGLGQAMILVQAYQLNGKREYLDAAQAMLDYVLGRNATDMSFVTGYGAKATMHPHHRPSGADKVAYPVPGFLAGGPQAGQQDKDDCEVAYPSPITAKSYLDHYCSYASNEVAINWNAPLVYVSAAIQALTPK

SEQ ID NO: 141 - DNA, 1875 bp, Unknown
  Obtained from environmental sample
atgaacaataaacttcccggtcgctctgctaatggcaagcgccattcaagtccacgcaagtccatcctcaactcggtcatcggtattttggcgggcagtttattgtctggcctcgctctggccgacgttcccgcactgacggtgcaaggcaacaaagtgttagtgggcggtaaatccgtcagccttgaaggcgtttcactgttctggagtagcactggctggggcgcagaaaagtattacaacgctgctaccgtcaagcgcgccaaaaccgagttcaacgctaacctgatccgcgcggcaataggccatggtgaagacggcgcagtcgatagagactggaacggtaatatggctcgccttgatgctgtagttcaagcagccatcgacaacgatatgtacgtcatcattgactaccatagccacaaagctcatcagaattggggagcagcagatgcattctttaaacaagtcgcgcagaagtggggcaagtacaacaacgttatttacgagatttataacgagcctgtcggtgccaactggcataccgacctgaaaccttatgccgagcatgtaggcgctacgattcgcgcaatcgatccggacaacctgatcattatgggcactccacaatggtcgcaagatgttgatattgcatccaccaataaagccaatgtatccaacctggcgtacaccattcacttctacgcccacgagcacaccggctggttgcgcgcgaaggcacaaactgcgctcaataacggtatcgccctatttgctaccgagtggggtatgaccggtgccaacggccgtggaccggtaaataaaggcgaaacctgggcctggatcgacttcctgcgcgccaatggcattagccatgcgggctgggcattccacgataaagatcgcgatgtcgccaccggcgaagttgaaacctcatcttatttctggagtgacggcagccttaaagagtccggtcattttattaaagagattcttgccggtcgtaaagatattggcggaggcggcggaggtggtggcgacggcggttcaaccggttcctgccaaaaagccggtctgggcgatacccttgaagcagaaaactattgccaggcgagcggcattgaaaccgaaaacaccagcgatgctggcggcggcaaaaatgtgggctacatcgacaacggcgactggttgacctactcgatcaatgtgcctgcaaccggcacttataaagtgagctatcgcgttgctgcctctgcaggcggcggtcaatttcagttagaaaaagccggcggcagccctgtttatggcaacgtaaacgtacctgcgactggcggttggcaaaactggcaaaccgtttcgcacaacgtggttttgccagccggtgagcagctgattgctatagcggcggtgaccggtggcttcaacgttaattggctgaaagtggaaagcaccggcacaccgccggataccaatcccggcaccgtgattaccaccatccaggcggaagcctttagccagcaacaaggcactgaactggaaaataccaccgataccggcggcggtaaaaatgtgggttatatcgatgcgggtgattggctctcttacgctggtacgccggtgaatatccccagcactggcagctatgtgattgagtatcgcgttgccagccaaagcggtggcggcagcctgacttttgaagaagcaggcggcactccggcctacggcaatcttgcgattccctctaccggtggctggcagacctggaccacggtaaaacacaccgtgaacctgactgcgggcagccacaagtttggcatcaaagtgaatgcgggaggatggaacctgaattggattcgcatcagcaaagccaattaa

SEQ ID NO: 142 - protein, 624 aa, Unknown
  Obtained from environmental sample
  SIGNAL (1)...(41)
  DOMAIN (50)...(305): Cellulase (glycosyl hydrolase family 5)
  DOMAIN (364)...(483): Carbohydrate binding module (family 6)
  DOMAIN (500)...(622): Carbohydrate binding module (family 6)
  SITE (169)...(178): Glycosyl hydrolases family 5 signature. Prosite id = PS00659
  SITE (227)...(230): N-glycosylation site. Prosite id = PS00001
  SITE (383)...(386): N-glycosylation site. Prosite id = PS00001
  SITE (521)...(524): N-glycosylation site. Prosite id = PS00001
  SITE (605)...(608): N-glycosylation site. Prosite id = PS00001
MNNKLPGRSANGKRHSSPRKSILNSVIGILAGSLLSGLALADVPALTVQGNKVLVGGKSVSLEGVSLFWSSTGWGAEKYYNAATVKRAKTEFNANLIRAAIGHGEDGAVDRDWNGNMARLDAVVQAAIDNDMYVIIDYHSHKAHQNWGAADAFFKQVAQKWGKYNNVIYEIYNEPVGANWHTDLKPYAEHVGATIRAIDPDNLIIMGTPQWSQDVDIASTNKANVSNLAYTIHFYAHEHTGWLRAKAQTALNNGIALFATEWGMTGANGRGPVNKGETWAWIDFLRANGISHAGWAFHDKDRDVATGEVETSSYFWSDGSLKESGHFIKEILAGRKDIGGGGGGGGDGGSTGSCQKAGLGDTLEAENYCQASGIETENTSDAGGGKNVGYIDNGDWLTYSINVPATGTYKVSYRVAASAGGGQFQLEKAGGSPVYGNVNVPATGGWQNWQTVSHNVVLPAGEQLIAIAAVTGGFNVNWLKVESTGTPPDTNPGTVITTIQAEAFSQQQGTELENTTDTGGGKNVGYIDAGDWLSYAGTPVNIPSTGSYVIEYRVASQSGGGSLTFEEAGGTPAYGNLAIPSTGGWQTWTTVKHTVNLTAGSHKFGIKVNAGGWNLNWIRISKAN

SEQ ID NO: 143 - DNA, 594 bp, Clostridium thermocellum
gtggtatttctgtggattggaggaaatgacctgcttttgagcggaaacgtgaatgcaacaggccttagtaatcttatagaccagattttcacagtgaaacccaatgtaacactgtttgtggccgattattatccgtggcctgaagcggtcaagcaatacaatgcggtgattccgggaatagttcaacagaaggccaatgccggcaagaaagtttattttgtaaagcttagtgagattcagtttgacaggaacaccgatatttcatgggatggtttgcacttgagcgaaataggatacacaaagattgcaaatatttggtacaagtatacgattgacatactaaaagctttggcaggacaaacgcagccaactccaagtccgtctccgactcccacagattctcctctggttaaaaaaggtgatgttaatttggacggtcaggtcaattcgacagatttcagccttttgaaaagatatatactgaaagttgtggatataaattcaataaatgtgacaaatgctgatatgaacaatgatggcaatatcaactctacagacatttcaatactaaagagaatacttcttagaaattag

SEQ ID NO: 144 - protein, 197 aa, Clostridium thermocellum
  DOMAIN (141)...(161): Dockerin type I repeat
  DOMAIN (175)...(195): Dockerin type I repeat
  SITE (18)...(21): N-glycosylation site. Prosite id = PS00001
  SITE (35)...(38): N-glycosylation site. Prosite id = PS00001
  SITE (143)...(162): Clostridium cellulosome enzymes repeated domain signature. Prosite id = PS00448
  SITE (151)...(154): N-glycosylation site. Prosite id = PS00001
  SITE (172)...(175): N-glycosylation site. Prosite id = PS00001
  SITE (177)...(196): Clostridium cellulosome enzymes repeated domain signature. Prosite id = PS00448
  SITE (177)...(189): EF-hand calcium-binding domain. Prosite id = PS00018
  SITE (185)...(188): N-glycosylation site. Prosite id = PS00001
MVFLWIGGNDLLLSGNVNATGLSNLIDQIFTVKPNVTLFVADYYPWPEAVKQYNAVIPGIVQQKANAGKKVYFVKLSEIQFDRNTDISWDGLHLSEIGYTKIANIWYKYTIDILKALAGQTQPTPSPSPTPTDSPLVKKGDVNLDGQVNSTDFSLLKRYILKVVDINSINVTNADMNNDGNINSTDISILKRILLRN

SEQ ID NO: 145 - DNA, 1689 bp, Clostridium thermocellum
gtgtataccggaacggcaacttcaatgtttgacaatgatacaaaagaaactgtttatattgctgatttttcatctgttaatgaagaaggaacgtactatcttgccgtgccgggagtaggaaaaagcgtaaactttaaaattgcaatgaatgtatatgaggatgcttttaaaacagcaatgctgggaatgtatttgctgcgctgcggcaccagtgtgtcggccacatacaacggaatacactattcccatggaccgtgccatactaatgatgcatatcttgattatataaacggacagcatactaaaaaagacagtacaaaaggctggcatgatgcgggcgactacaacaaatatgtggtaaacgccggcataaccgttggttcaatgttcctggcgtgggagcattttaaagaccagttggagcctgtggcattggagattcccgaaaagaacaattcaataccggattttcttgatgaattaaaatatgagatagactggattcttaccatgcaataccctgacgggagcggaagggtggctcataaagtttcgacaaggaactttggcggctttatcatgcctgagaacgaacacgacgaaagatttttcgtgccctggagcagtgccgcaacggcagactttgttgccatgacggccatggctgcaagaatattcaggccttatgatcctcaatatgctgaaaaatgtataaatgcggcaaaagtaagctatgagtttttgaagaacaatcctgcgaatgtttttgcaaaccagagtggattctcaacaggagaatatgccactgtcagtgatgcagatgacagattgtgggcggcggctgaaatgtgggagaccctgggagatgaagaataccttagagattttgaaaacagggcggcgcaattctcgaaaaaaatagaagccgattttgactgggataatgttgcaaacttaggtatgtttacatatcttttgtcagaaagaccgggcaagaatcctgctttggtgcagtcaataaaggatagtctcctttccactgcggattcaattgtgaggaccagccaaaaccatggctatggcagaacccttggtacaacatattactggggatgcaacggcacggttgtaagacagactatgatacttcaggttgcgaacaagatttcacccaacaatgattatgtaaatgctgctctcgatgcgatttcacatgtatttggaagaaactattacaacaggtcttatgtaacaggccttggtataaatcctcctatgaatcctcatgacagacgttcaggggctgacggaatatgggagccgtggcccggttaccttgtaggaggaggatggcccggaccgaaggattgggtggatattcaggacagttatcagaccaatgaaattgctataaactggaatgcggcattgatttatgcccttgccggatttgtcaactataattctgctcaaaatgaagtactgtacggagatgtgaatgatgacggaaaagtaaactccactgacttgactttgttaaaaagatatgttcttaaagccgtctcaactctgccttcttccaaagctgaaaagaacgcagatgtaaatcgtgacggaagagttaattccagtgatgtcacaatactttcaagatatttgataagggtaatcgagaaattaccaatataa

SEQ ID NO: 146 - protein, 562 aa, Clostridium thermocellum
  DOMAIN (51)...(484): Glycosyl hydrolase family 9
  DOMAIN (498)...(518): Dockerin type I repeat
  DOMAIN (534)...(554): Dockerin type I repeat
  SITE (12)...(15): N-glycosylation site. Prosite id = PS00001
  SITE (153)...(156): N-glycosylation site. Prosite id = PS00001
  SITE (261)...(264): N-glycosylation site. Prosite id = PS00001
  SITE (378)...(381): N-glycosylation site. Prosite id = PS00001
  SITE (419)...(422): N-glycosylation site. Prosite id = PS00001
  SITE (421)...(437): Glycosyl hydrolases family 9 active sites signature 1. Prosite id = PS00592
  SITE (464)...(482): Glycosyl hydrolases family 9 active sites signature 2. Prosite id = PS00698
  SITE (505)...(517): EF-hand calcium-binding domain. Prosite id = PS00018
  SITE (505)...(524): Clostridium cellulosome enzymes repeated domain signature. Prosite id = PS00448
  SITE (513)...(516): N-glycosylation site. Prosite id = PS00001
  SITE (542)...(561): Clostridium cellulosome enzymes repeated domain signature. Prosite id = PS00448
  SITE (542)...(554): EF-hand calcium-binding domain. Prosite id = PS00018
  SITE (550)...(553): N-glycosylation site. Prosite id = PS00001
MYTGTATSMFDNDTKETVYIADFSSVNEEGTYYLAVPGVGKSVNFKIAMNVYEDAFKTAMLGMYLLRCGTSVSATYNGIHYSHGPCHTNDAYLDYINGQHTKKDSTKGWHDAGDYNKYVVNAGITVGSMFLAWEHFKDQLEPVALEIPEKNNSIPDFLDELKYEIDWILTMQYPDGSGRVAHKVSTRNFGGFIMPENEHDERFFVPWSSAATADFVAMTAMAARIFRPYDPQYAEKCINAAKVSYEFLKNNPANVFANQSGFSTGEYATVSDADDRLWAAAEMWETLGDEEYLRDFENRAAQFSKKIEADFDWDNVANLGMFTYLLSERPGKNPALVQSIKDSLLSTADSIVRTSQNHGYGRTLGTTYYWGCNGTVVRQTMILQVANKISPNNDYVNAALDAISHVFGRNYYNRSYVTGLGINPPMNPHDRRSGADGIWEPWPGYLVGGGWPGPKDWVDIQDSYQTNEIAINWNAALIYALAGFVNYNSAQNEVLYGDVNDDGKVNSTDLTLLKRYVLKAVSTLPSSKAEKNADVNRDGRVNSSDVTILSRYLIRVIEKLPI

SEQ ID NO: 147 - DNA, 972 bp, Unknown
  Obtained from environmental sample
atggcaaaaaaaccaagatatttagtacatgataattacacggccgacccatcggctcatgtgttcaatggccgtatctatatttacccatcgcacgatgtggatgcaggcatccctgaaaatgacctcggcgaccatttcgatatgcgcgactaccatgtctattcaatggacgatgttaatggcgaagttacagatcatggggtagttcttcatgttaaagacataccctgggctggtcgccagctctgggctcctgatgcagcctataaaaatgggaaatactatctctatttccctttaaaggataaaactgatattttcaggataggtgttgctgtaagcgataaaccggaaggcccgtttattcctgagccagatcctatcagaggaagttatagtattgatcctgctgttcttgatgatggtgatggcaatttttacatgtactttggaggtttgtggggcggccaattacagcgctaccgcaacaacaaagctattgaatgtggacacgagccggctgacaatgaacccgccctttcggcccgagtggtgcgccttagcgacgatatgctgcaattcgctgaagaaccccgcgatgtgctgcttctcgacgaaaacggggagcccattaaggctggcgaccacgaccgtcgttatttcgaaggcccatggatgcataagtacaacggaaaatattatttttcctattcaaccggcaatacacattttctctgctatgccataggcgacaatccttacggcccatttacctacaaaggaaaaatacttactccagttgtaggttggaccacacaccattctatttgcgagtttaaagggaaatggtatcttttctatcacgacagtgtaccttccggcggcaaaacatggcttcgaagtattaaggttattgagttggaaatcaaccccgatggtactattgtaaccatcgacggaatgttatag

SEQ ID NO: 148 - protein, 323 aa, Unknown
  Obtained from environmental sample
  DOMAIN (5)...(316): Glycosyl hydrolases family 43
  SITE (12)...(15): N-glycosylation site. Prosite id = PS00001
MAKKPRYLVHDNYTADPSAHVFNGRIYIYPSHDVDAGIPENDLGDHFDMRDYHVYSMDDVNGEVTDHGVVLHVKDIPWAGRQLWAPDAAYKNGKYYLYFPLKDKTDIFRIGVAVSDKPEGPFIPEPDPIRGSYSIDPAVLDDGDGNFYMYFGGLWGGQLQRYRNNKAIECGHEPADNEPALSARVVRLSDDMLQFAEEPRDVLLLDENGEPIKAGDHDRRYFEGPWMHKYNGKYYFSYSTGNTHFLCYAIGDNPYGPFTYKGKILTPVVGWTTHHSICEFKGKWYLFYHDSVPSGGKTWLRSIKVIELEINPDGTIVTIDGML

SEQ ID NO: 149 - DNA, 1431 bp, Unknown
  Obtained from an environmental sample
atgaaaactaattatagatttggagggattaaaatgttttctaaagactttttatttggagcatctttgtctggatttcagtttgaaatgggaaatccaaataatgaagaggaattagacaaaaacacagattggtttgtttgggtaagagacttaggaaatataattaatggaaaagttagtggagatcttcctgaatatggtgcaggatattatactaattacaaggcagttcacaatcttgcaaaagaatttggaatgaatgctttaagaattggaatagaatggtcaagaatttttaaagaaagcacaaaagatattagcccagatgatcctaacatgttagaaaaacttgatcaactagctgataaaaaggcgattgaacattatagagatgtattagaagacataaaaagtaaaggacttgtagctattgttaatttgtcgcactttactttaccactttggcttcatgatccaataaatgtacacaaaggaaaggaaacaaaaaagcttggttgggtaagtgatgatgcaccaatagaatttgctaaatacgcagaatacatcgcatggaaatttaaagatattgttgatatgtggtcttcaatgaatgaacctcacgtggtaagtcagcttggttattttcaaacaagtgcaggttttccaccaagctattttaatccttcatggtatctaaaaagtcttgaaaatcaagctttagcacataaccttgcttatgatgctataaaaaaacatacagacaagccagttggagttatttattcatttacgtggtatgatacagttaataatgatgaagaaatattcgaaagtgcaatgtttttaaataactggaattatatggatagagtaaaggataaaattgactttgtaggtgtaaattattatacaagggctgttatagaccgacttttggttcctataaaaattgataattatgaattaaattggtatactcttagtggttatgggtattcatgtgttgaagatggttttgcaaattcaaaaagaccttcaagcgaaattggttgggagatatatccagaagggctttataatattctcaaagaaatatacaatagatatggaaagcaaatctatataacggaaaatggtatagcagattcaagcgataaatacagaagcttttatattatttcccacctttatgcagtagaaaaagcaataaacgaaggagtaccagtaaaaggataccttcactggtcaataatagataattatgaatgggcaaaaggttatggtaaaagatttggacttgcctatacagattttgaaagaaaaacttatattccaagaccttctatgtatattttaagagaaataataaaagaaagaactattgataagtttaaaggatatgatccgtacggattaatgaatttttga

SEQ ID NO: 150 - protein, 476 aa, Unknown
  Obtained from an environmental sample
  DOMAIN (9)...(462): Glycosyl hydrolase family 1
  SITE (17)...(31): Glycosyl hydrolases family 1 N-terminal signature. Prosite id = PS00653
  SITE (149)...(152): N-glycosylation site. Prosite id = PS00001
  SITE (379)...(387): Glycosyl hydrolases family 1 active site. Prosite id = PS00572
MKTNYRFGGIKMFSKDFLFGASLSGFQFEMGNPNNEEELDKNTDWFVWVRDLGNIINGKVSGDLPEYGAGYYTNYKAVHNLAKEFGMNALRIGIEWSRIFKESTKDISPDDPNMLEKLDQLADKKAIEHYRDVLEDIKSKGLVAIVNLSHFTLPLWLHDPINVHKGKETKKLGWVSDDAPIEFAKYAEYIAWKFKDIVDMWSSMNEPHVVSQLGYFQTSAGFPPSYFNPSWYLKSLENQALAHNLAYDAIKKHTDKPVGVIYSFTWYDTVNNDEEIFESAMFLNNWNYMDRVKDKIDFVGVNYYTRAVIDRLLVPIKIDNYELNWYTLSGYGYSCVEDGFANSKRPSSEIGWEIYPEGLYNILKEIYNRYGKQIYITENGIADSSDKYRSFYIISHLYAVEKAINEGVPVKGYLHWSIIDNYEWAKGYGKRFGLAYTDFERKTYIPRPSMYILREIIKERTIDKFKGYDPYGLMNF

SEQ ID NO: 151 - DNA, 1008 bp, Unknown
  Obtained from an environmental sample
atgaggaacttttttaaagtctttacattagttttggtggtgatttctgtgatgctgtttggtgaaaataaaaaacttacggcatttgattacaataaaatgataggtattggaattaacatgggaaatgcgcttgaagcaccatttgaaggtgcatggggagtggttataaaagatgaatattttaaaataataaaagaaaaaggatttgattcagttagaatacctattagatggtcagcgcatattttagataaaccaccttatacaatagaaaaggattttttagaaagagtaaaacatgtagttgataaggctttggaaaatgatttggttgtaataattaattgccatcattttgaggagttatatgaaaaccctgaaaagtacggagaagttcttttagaaatttggaaacaagtatcagatttctttaaaaattattctgacaagctttattttgaaatttataacgaacctgcaaataatttaaccccagaaaaatggaatgatttgtatccaaaagttttaaaagaaatcaggaaaacaaacccaacaagaattgtaatagtagatgtgcctcattggggaaattacaattacatcaatcaattaaaacttgtaaatgatccatatttaatcgtatcttttcactattatgaaccattcaactttactcaccaaggtgctgaatggataaacccgcgccttccagtgggggttaaatggagtgcaaaaagttatgaaatagaacagataaaatcacattttgaatatgtaaattctttttcaaaaaagtacaatgttccaatatttttaggggaatttggggcttactcaaaggcagatatggattctcgaatcaaatggacaaaagcggttagtcaaattgctagagaatttggattttcaatttgttattgggaattttgttctggttttgggctttacaataaaataacaaatacttggaatgaaggattgttaaacgctgtttttggaaaataa

SEQ ID NO: 152 - protein, 335 aa, Unknown
  Obtained from an environmental sample
  SIGNAL (1)...(21)
  DOMAIN (42)...(318): Cellulase (glycosyl hydrolase family 5)
  SITE (149)...(152): N-glycosylation site. Prosite id = PS00001
  SITE (227)...(230): N-glycosylation site. Prosite id = PS00001
MRNFFKVFTLVLVVISVMLFGENKKLTAFDYNKMIGIGINMGNALEAPFEGAWGVVIKDEYFKIIKEKGFDSVRIPIRWSAHILDKPPYTIEKDFLERVKHVVDKALENDLVVIINCHHFEELYENPEKYGEVLLEIWKQVSDFFKNYSDKLYFEIYNEPANNLTPEKWNDLYPKVLKEIRKTNPTRIVIVDVPHWGNYNYINQLKLVNDPYLIVSFHYYEPFNFTHQGAEWINPRLPVGVKWSAKSYEIEQIKSHFEYVNSFSKKYNVPIFLGEFGAYSKADMDSRIKWTKAVSQIAREFGFSICYWEFCSGFGLYNKITNTWNEGLLNAVFGK

SEQ ID NO: 153 - DNA, 1068 bp, Unknown
  Obtained from an environmental sample
atgaaaaggcgtaactggaattatcttctgattattttattggtcatttccgcattcactttgatatcggcccagtgcgataaagataaaactaaagaaggagagaagaatatggttcaatcaaccaaaggcaagtctgtctttgaattgaataaaatgattgggaaaggagtaaatataggaaatgctttggaagcaccggttgaaggtgcatggggagttagaatagaggacgaatacttcgaagtcataaagaaaaggggatttgactctgtaaggattcccataagatggtcggcgcacatttccgataaaccgccgtacaaaatcgaagaatattttctcgaaagggttaaacatgtagtagataaggcacttgagaataaccttactgtgattatcaacacccatcatttcgaagaactctaccaagacccagacaaatatggtggagtgctggttgaaatctggcgccaagttgccagtttcttcaaagactatcctgaaacgttattcttcgaaatctacaatgaacctgcgcagaacttaacaggcgataagtggaacaagctctatccaaaggtgcttgaggttattagagagagcaatccggacagagtagttatcatcgacgttccgaactgggctcattacagtgcgataagcagtttgaaattagtgaacgataaacgtatcatcgtttcatttcactactacgaacctttcaatttcacacatcagggtgctgaatgggtcaatcctgttccaccagttggtgtgaagtggaacggggaggattgggaagtaaatcagatcaaaaatcatttcagatacgttagtgactgggcaaaaaagaataacgtgcctatctttcttggcgaatttggtgcttattcgaaggcggacatggattcaagagtcaaatggacggaaactgtgagaaaaaccgctgaagagtttggtttttcctatgcgtattgggaattctgtgcagggtttggcatatacgataggtgggctgaaaaatggatcgaaccgctggcaaccgctgtggttgggaataattaa

SEQ ID NO: 154 - protein, 355 aa, Unknown
  Obtained from an environmental sample
  SIGNAL (1)...(25)
  DOMAIN (61)...(337): Cellulase (glycosyl hydrolase family 5)
  SITE (184)...(187): N-glycosylation site. Prosite id = PS00001
  SITE (246)...(249): N-glycosylation site. Prosite id = PS00001
MKRRNWNYLLIILLVISAFTLISAQCDKDKTKEGEKNMVQSTKGKSVFELNKMIGKGVNIGNALEAPVEGAWGVRIEDEYFEVIKKRGFDSVRIPIRWSAHISDKPPYKIEEYFLERVKHVVDKALENNLTVIINTHHFEELYQDPDKYGGVLVEIWRQVASFFKDYPETLFFEIYNEPAQNLTGDKWNKLYPKVLEVIRESNPDRVVIIDVPNWAHYSAISSLKLVNDKRIIVSFHYYEPFNFTHQGAEWVNPVPPVGVKWNGEDWEVNQIKNHFRYVSDWAKKNNVPIFLGEFGAYSKADMDSRVKWTETVRKTAEEFGFSYAYWEFCAGFGIYDRWAEKWIEPLATAVVGNN

SEQ ID NO: 155 - DNA, 1794 bp, Unknown
  Obtained from environmental sample
atgaagagagttgcaattatattaagtgtcctgacactacttgcaacaattatgagttttccagcctctgctcaagagcccataatacgagagttcccaggcaaccaatggcctacagcgtttgtcgacatgaatggggatggcatttcagatttcgtaatggaaatcaatccatggaacatccaagacgcagatggaaagcaaatcatggaatacgatcctgttagtaatgaaatacggttctttagcaacttaacaaacatcattactaaaaatcccaatacttgggttcatgggtacccggagatatacattgggaacaagccttggaacagaaataaagcggatggacttatagatctaccaaagaaggtgtcagatcttactggctttactgtaaaatttagttacaaccttgagcatgatcctaatctgccaattaattttgcaatggaaacttggttaacaacggatcaactaaggacaactggagttagggctggagaagtagagatcatggtctggctttataataacaagataaatccggctggtagaataatagacacagtcaagatacccatcattattaatggaaaactcataaacgggacatttgaagtttggaagaaagatagcattggtagtggatggacgtactttgcctttagattgacaacaccaatgaagagtgcagaaatagaaattgatccaacattatttgtcaaaaaagttcaagaatacacacaagtggatataggaaatctctacatgcaggattgggaaattggtacagagtttggaaatcctacaactacatcagcactctttaactggagtataaagaatttcgaagttagcaagcaacctttactccaacaagatgtggaatcaccctcaacaacgtcttccataccacaaacccagacgacatcttcaaacattcagaatccaataagacctggaacacttgacgttagggtaaatagctggggaagtgctacccaatactcatgcaccctctatcttgacggtcaatatgactggactattgaagtcaagctaaaggatggttcaaagatcacaagttactggagcgctgatcttacctacaaggaagatgggaccgcagtattcacaccaaagagctggaacaagggtccaacagctagcttcggattcatagcatccggagatatgcccgttgagtcaatagtgcttgttataaacggtgaggtttgggatgtgtggcctgaggtgtctcaggtgccgtctgagacgggtactactacgactactaccacagcaactccagctccaactacaaccactacaactaccactacaactacgagcactccaacccagactactaccactactacagtaactccggctccaactactaccacgacaactactgtctcaacaactactaccactataactacgagtactgtgactactacaactacacaggttgttccagttaggcctggttcgatgagtgttaaggttaatgattggggtactggtgggcagtttgacattaccctaaaccttggtgggcagtacgattgggttgttaaagtccagcttgattcatcaacccaaatgggcaactactggggtgttcagaagagccaagagggtgattgggtagtcttcacgccactcagttggaacaagggtccaacagccgtctttggattcattgtaaacggcccagtcagcggagtcaaacaaataatcctcgaaataaacggagaagtttgggacatatggtcacaatga

SEQ ID NO: 156 - protein, 597 aa, Unknown
  Obtained from environmental sample
  SIGNAL (1)...(24)
  DOMAIN (117)...(289): Glycosyl hydrolase family 12
  DOMAIN (500)...(582): Cellulose binding domain
  SITE (85)...(88): N-glycosylation site. Prosite id = PS00001
  SITE (206)...(209): N-glycosylation site. Prosite id = PS00001
  SITE (282)...(285): N-glycosylation site. Prosite id = PS00001
MKRVAIILSVLTLLATIMSFPASAQEPIIREFPGNQWPTAFVDMNGDGISDFVMEINPWNIQDADGKQIMEYDPVSNEIRFFSNLTNIITKNPNTWVHGYPEIYIGNKPWNRNKADGLIDLPKKVSDLTGFTVKFSYNLEHDPNLPINFAMETWLTTDQLRTTGVRAGEVEIMVWLYNNKINPAGRIIDTVKIPIIINGKLINGTFEVWKKDSIGSGWTYFAFRLTTPMKSAEIEIDPTLFVKKVQEYTQVDIGNLYMQDWEIGTEFGNPTTTSALFNWSIKNFEVSKQPLLQQDVESPSTTSSIPQTQTTSSNIQNPIRPGTLDVRVNSWGSATQYSCTLYLDGQYDWTIEVKLKDGSKITSYWSADLTYKEDGTAVFTPKSWNKGPTASFGFIASGDMPVESIVLVINGEVWDVWPEVSQVPSETGTTTTTTTATPAPTTTTTTTTTTTSTPTQTTTTTTVTPAPTTTTTTTVSTTTTTITTSTVTTTTTQVVPVRPGSMSVKVNDWGTGGQFDITLNLGGQYDWVVKVQLDSSTQMGNYWGVQKSQEGDWVVFTPLSWNKGPTAVFGFIVNGPVSGVKQIILEINGEVWDIWSQ

SEQ ID NO: 157 - DNA, 1107 bp, Unknown
  Obtained from environmental sample
atgaatgtgttgcgtagtggaatcgtgacgatgctgctgttggctgcctttagtgttcaggcagcctgtacctggcctgcctgggagcagtttaaaaaggattacatcagtcaggaagggcgcgtcatcgaccccagcgacgcgcgcaaaatcaccacctccgaagggcaaagttacggtatgttctttgccctggcggctaacgaccgtgtagctttcgataatattctcgactggacgcagaacaatctcgctcagggctctttaaaagaacgtttgcccgcctggctgtggggcaagaaagagaacagtaagtgggaagtgctggacagcaattcggcctccgatggtgatgtctggatggcctggtcgttgctggaggcggggcgtttgtggaaagagcagcgttataccgacatcggcagcgcgttgctaaaacgtatcgcgcgggaggaagtggtgacggtgcctgggctgggttccatgttgttaccgggcaaagtgggttttgctgaggataacagctggcgttttaaccccagctacctgccgccgacgctggcgcagtatttcacccgctttggcgcgccgtggaccacgctgcgcgaaaccaatcaacgtttattgctggaaaccgccccgaaaggtttttcgccagactgggtgcgctatgagaaagacaaaggctggcagctaaaagccgaaaaaacattgatcagcagctacgacgctatccgcgtttacatgtgggtaggcatgatgcctgacagcgatccgcaaaaagcgcggatgctcaaccggtttaaaccgatggcgacattcactgagaaaaacggttatccgccggaaaaagtggatgtggctacggggaaagcgcagggtaaaggaccggtcggtttttctgccgccatgctgccctttttacaaaaccgcgatgcgcaggccgttcagcgccagcgcgtggccgataactttcccggcagcgatgcctattacaactatgtgctgaccctgtttggacaaggctgggatcaacaccgtttccgcttctcgacaaaaggtgagttattacctgactggggccaggaatgcgcaaattcacactaa

SEQ ID NO: 158 - protein, 368 aa, Unknown
  Obtained from environmental sample
  SIGNAL (1)...(21)
  DOMAIN (1)...(346): Glycosyl hydrolases family 8
MNVLRSGIVTMLLLAAFSVQAACTWPAWEQFKKDYISQEGRVIDPSDARKITTSEGQSYGMFFALAANDRVAFDNILDWTQNNLAQGSLKERLPAWLWGKKENSKWEVLDSNSASDGDVWMAWSLLEAGRLWKEQRYTDIGSALLKRIAREEVVTVPGLGSMLLPGKVGFAEDNSWRFNPSYLPPTLAQYFTRFGAPWTTLRETNQRLLLETAPKGFSPDWVRYEKDKGWQLKAEKTLISSYDAIRVYMWVGMMPDSDPQKARMLNRFKPMATFTEKNGYPPEKVDVATGKAQGKGPVGFSAAMLPFLQNRDAQAVQRQRVADNFPGSDAYYNYVLTLFGQGWDQHRFRFSTKGELLPDWGQECANSH

SEQ ID NO: 159 - DNA, 1500 bp, Unknown
  Obtained from environmental sample
atgaaacggtcaatctctatttttattacgtgtttattgattacgttattgacaatgggcggcatgatagcttcgccggcatcagcagcagggacaaaaacgccagtagccaagaatggccagcttagcataaaaggtacacagctcgttaaccgagacggtaaagcggtacagctgaaggggatcagttcacacggattgcaatggtatggagaatatgtcaataaagacagcttaaaatggctgagagatgattggggtatcaccgttttccgtgcagcgatgtatacggcagatggcggttatattgacaacccgtccgtgaaaaataaagtaaaagaagcggttgaagcggcaaaagagcttgggatatatgtcatcattgactggcatatcttaaatgacggtaatccaaaccaaaataaagagaaggcaaaagaattcttcaaggaaatgtcaagcctttacggaaacacgccaaacgtcatttatgaaattgcaaacgaaccaaacggtgatgtgaactggaagcgtgatattaaaccatatgcggaagaagtgatttcagttatccgcaaaaatgatccagacaacatcatcattgtcggaaccggtacatggagccaggatgtgaatgatgctgccgatgaccagctaaaagatgcaaacgttatgtacgcacttcatttttatgccggcacacacggccaatttttacgggataaagcaaactatgcactcagcaaaggagcacctatttttgtgacagagtggggaacaagcgacgcgtctggcaatggcggtgtattccttgatcaatcgagggaatggctgaaatatctcgacagcaagaccattagctgggtgaactggaatctttctgataagcaggaatcatcctcagctttaaagccgggggcatctaaaacaggcggctggcggttgtcagatttatctgcttcaggaacattcgttagagaaaacattctcggcaccaaagattcgacgaaggacattcctgaaacgccatcaaaagataaacccacacaggaaaatggtatttctgtacagtacagagcaggggatgggagtatgaacagcaaccaaatccgtccgcagcttcaaataaaaaataacggcaataccacggttgatttaaaagatgtcactgcccgttactggtataaagcgaaaaacaaaggccaaaactttgactgtgactacgcgcagattggatgcggcaatgtgacacacaagtttgtgacgttgcataaaccaaagcaaggtgcagatacctatctggaacttggatttaaaaacggaacgttggcaccgggagcaagcacagggaatattcagctccgtcttcacaatgatgactggagcaattatgcacaaagcggcgattattcctttttcaaatcaaatacgtttaaaacaacgaaaaaaatcacattatatgatcaaggaaaactgatttggggaacagaaccaaattag

SEQ ID NO: 160 - protein, 499 aa, Unknown
  Obtained from environmental sample
  SIGNAL (1)...(29)
  DOMAIN (47)...(301): Cellulase (glycosyl hydrolase family 5)
  DOMAIN (356)...(437): Cellulose binding domain
  SITE (164)...(173): Glycosyl hydrolases family 5 signature. Prosite id = PS00659
  SITE (296)...(299): N-glycosylation site. Prosite id = PS00001
  SITE (386)...(389): N-glycosylation site. Prosite id = PS00001
  SITE (421)...(424): N-glycosylation site. Prosite id = PS00001
  SITE (446)...(449): N-glycosylation site. Prosite id = PS00001
MKRSISIFITCLLITLLTMGGMIASPASAAGTKTPVAKNGQLSIKGTQLVNRDGKAVQLKGISSHGLQWYGEYVNKDSLKWLRDDWGITVFRAAMYTADGGYIDNPSVKNKVKEAVEAAKELGIYVIIDWHILNDGNPNQNKEKAKEFFKEMSSLYGNTPNVIYEIANEPNGDVNWKRDIKPYAEEVISVIRKNDPDNIIIVGTGTWSQDVNDAADDQLKDANVMYALHFYAGTHGQFLRDKANYALSKGAPIFVTEWGTSDASGNGGVFLDQSREWLKYLDSKTISWVNWNLSDKQESSSALKPGASKTGGWRLSDLSASGTFVRENILGTKDSTKDIPETPSKDKPTQENGISVQYRAGDGSMNSNQIRPQLQIKNNGNTTVDLKDVTARYWYKAKNKGQNFDCDYAQIGCGNVTHKFVTLHKPKQGADTYLELGFKNGTLAPGASTGNIQLRLHNDDWSNYAQSGDYSFFKSNTFKTTKKITLYDQGKLIWGTEPN

SEQ ID NO: 161 - DNA, 1185 bp, Unknown
  Obtained from environmental sample
gtgcggggacaaaagttatgggttgcgctggcggcgcttctgtcggtggggtcggtcgcgttggcctctgtcgggactaaggggccggatcgttctccgctgctcgggcatgccgccgtccggaagccgtcgcaggccggcgccctgcagctcgtccttcgggacggccgacggacgctcgcggacgagcgcggccggatgattcagctgcgcggcatgagcacgcacgggttgcaatggtttccgcagattctgaacgacaacgcgttcgcggcgttggcggaggactggggcgccaacgtcgtccggctggccatgtatgtgggcgaaggggggtatgctgcggacccggacaagttccggcaaagggcgatgcgcggcatcgatctggcgatcgcgcacgatctgtacgtcatcgtcgactggcacgtgctgacgccgggagatccgcgggccgatgtgtacagcggcgcaatggaattttttcggtcggtgtcggctcggtatccgaacgatccgcacctgctgtacgagctggccaacgagccgaacggcgggagcgcggacgggcagccgggcatcccgaacgatgcggacggctggaaggcggtcaaggcgtacgcccagccgatcgtcgatatgctgcgcgagaccggcaacggcaatatcgtcatcgtcggctcgccgaactggagccaacggccggacctggccgcggacgatccgatcgacgacccgctgaaccggacgatgtacgcgttccacttctatgccgggtcgcatcggttctccgcggacagcggggaccggcagaacgtgatgagcaacgtccgctacgcgctggagcgcggagccgccgtgttcgcgaccgagtgggggacgagcgaggccagcggcaacggcggcccgtacatggaggcagcggatgcgtggctgtcgttcctgaacgaaaacaacatcagctggacgaactggtcgctggcgaacaaggacgagacttcggccgctttgcggcctttcacgctgggcgggctgccggcggcttcgctcgaccccggcgaaggccgcgcctggactccggaggagctgagcgtcagcggggagtacgtgcgggcgcggatcaagggcatcccgtacaagcccatcgaccgcagcgcgccgggcgcgcggcgtcctttgggctaa

SEQ ID NO: 162 - protein, 394 aa, Unknown
  Obtained from environmental sample
  SIGNAL (1)...(22)
  DOMAIN (58)...(335): Cellulase (glycosyl hydrolase family 5)
  SITE (177)...(186): Glycosyl hydrolases family 5 signature. Prosite id = PS00659
  SITE (233)...(236): N-glycosylation site. Prosite id = PS00001
  SITE (251)...(254): N-glycosylation site. Prosite id = PS00001
  SITE (323)...(326): N-glycosylation site. Prosite id = PS00001
MRGQKLWVALAALLSVGSVALASVGTKGPDRSPLLGHAAVRKPSQAGALQLVLRDGRRTLADERGRMIQLRGMSTHGLQWFPQILNDNAFAALAEDWGANVVRLAMYVGEGGYAADPDKFRQRAMRGIDLAIAHDLYVIVDWHVLTPGDPRADVYSGAMEFFRSVSARYPNDPHLLYELANEPNGGSADGQPGIPNDADGWKAVKAYAQPIVDMLRETGNGNIVIVGSPNWSQRPDLAADDPIDDPLNRTMYAFHFYAGSHRFSADSGDRQNVMSNVRYALERGAAVFATEWGTSEASGNGGPYMEAADAWLSFLNENNISWTNWSLANKDETSAALRPFTLGGLPAASLDPGEGRAWTPEELSVSGEYVRARIKGIPYKPIDRSAPGARRPLG

SEQ ID NO: 163 - DNA, 2529 bp, Unknown
  Obtained from an environmental sample
atgtcgaaaataaaacaccctaaattattactttgcttattgcctgtttttggcatgttcaactgtcaaaatgtattgagtgcagacaatcagcaagttaactggccttatgtgaatacgcaacttaagcgtgatccagccgttgaaaaacagattgataaactgctcgcaacaatgactttagagcaaaaagttgcgcaaatgatccagccagaaattggttatttaagtgtagagcaaatgaaaaagtatggatttggctcttatctaaatggcggaaatactgccccttacggaaataaacgagcggatcaagctacttggttaaaatacgcagatgaaatgtacctagcctctatggattcgaccatagatggtattgcgatcccgacggtatggggaaccgatgccatgcatgggcatagtaatgtgtatggcgctacgttatttccgcacaatattggcttaggagctgcgcatgatgctgatttaattaaacgcataggccaagcaacagcaaaggaagtatctgctacagggattgaatggagttttgcgcctactgttgctgtagttagagatgatcgctggggcagaacttatgaaagttactcagaagaccctgaattagttaggttgtatgcaggtagtatggtgaccggtattcaaggtgacataggcgctgactttttaaaaggcagtaaccgtattgccaccgctaagcactttgtgggtgatggtggcactgagcgaggcgttgatcgcggaaatacgcttatcgatgaaaaaggattaagagatattcacagcgcaggttatttttctgctattaatgaaggcgtgcaatcagtgatggcatcctttaatagttggaatggcaaacgtgtacatggcgataagcatttattaacggatgtacttaaaaaccaacttggttttgatgggtttgtagtaagcgactggaatgcgcataagtttgtagaaggctgcgatttagagcaatgcgcccaagccataaacgcaggtgttgatgtaatcatggtgccagagcattttgaagcgttttatcataatactgttaagcaagtgaaagagggggtaatagccgaatcaagaataaacgatgcggttagacgctttttaagggctaaaatccgctggggggtgtttacaaagggtaaaccatcagcacgacctgaatcacaacacccacagtggttaggcgctaatgagcatcgcactttggcaagagaagcggttcgcaagtcactcgttctattaaaaaacaacgaaaacgttttgccaattaaagcgcatagtcgcatcttagttgccggtaaaggcgccaatgcaatcaatatgcaagcaggtggctggagcgtttcttggcagggcacagacaatactaatagcgactttccaaatgcgacctctatttatgcaggtttaaagtcgcaagtattaaaagcaggcggtgaaataagcttaagtgagtctggtgactataaaaccaagccagatgtagccattgttgttattggtgaagaaccttatgctgagtggtttggtgatatagaaatgctagagtttcagcatgaaagcaaacacgctcttgcactgctgaaaaaacttaaggcagataatattacggtagtcaccgtatttttaagtggtcgcccgctttgggtcaataaagaactcaatgcatcagatgcctttgttgctgcatggttaccaggctctgagggtgagggagttgcagacgtattactaacagataaaaacggtaacagtcagtttgattttagcggtaagttgagtttttcgtggcctaaatacgacgaccaatttagccttaacttaggcgatgtaaattacgacccgctctttgcctatggctacgggctaacttatcaagacacagtaaacatacctgttgtgagtgaaactacaagccctaaaaaaatcgttaaaagcgatgcacacccattgtttgtaaaaagtttagctaaaaatctcacttgggcgttagctgatacaacagcaaaggttttaactagtggttcatcggccaccagtggcgataaaaaaagtttgttaatgcaatcggttaatttatcgtatcaagaggatgcaaggcagtttaagtggcaatctcaatcctcagatgcaacgcttagcctaagttacttaaaacctacgctactcgaacgcaaatttaaatcaggttaccttgaactaaaaatgcgattagataaagctccagagcaaggtgcccagttacaagtaatgtgtaatttagataactgtttaagaagtattgatttttcatcgtttgaaaaaacaatggcagataagcgctggcatactttatcaatcgcactcaattgcgccgatagcgaactgattgaacaatccatgtcagatgtaattcgtatttcagctcagcgtttaagtttagcagttgcagatatcgcgttgactgcaaaacctaataatgatgcattatcaatcacgtgctcaaaataa

SEQ ID NO: 164 - protein, 842 aa, Unknown
  Obtained from an environmental sample
  SIGNAL (1)...(27)
  DOMAIN (126)...(348): Glycosyl hydrolase family 3 N terminal domain
  DOMAIN (424)...(640): Glycosyl hydrolase family 3 C terminal domain
  SITE (310)...(327): Glycosyl hydrolases family 3 active site. Prosite id = PS00775
  SITE (482)...(485): N-glycosylation site. Prosite id = PS00001
  SITE (556)...(559): N-glycosylation site. Prosite id = PS00001
  SITE (576)...(579): N-glycosylation site. Prosite id = PS00001
  SITE (682)...(685): N-glycosylation site. Prosite id = PS00001
  SITE (715)...(718): N-glycosylation site. Prosite id = PS00001
MSKIKHPKLLLCLLPVFGMFNCQNVLSADNQQVNWPYVNTQLKRDPAVEKQIDKLLATMTLEQKVAQMIQPEIGYLSVEQMKKYGFGSYLNGGNTAPYGNKRADQATWLKYADEMYLASMDSTIDGIAIPTVWGTDAMHGHSNVYGATLFPHNIGLGAAHDADLIKRIGQATAKEVSATGIEWSFAPTVAVVRDDRWGRTYESYSEDPELVRLYAGSMVTGIQGDIGADFLKGSNRIATAKHFVGDGGTERGVDRGNTLIDEKGLRDIHSAGYFSAINEGVQSVMASFNSWNGKRVHGDKHLLTDVLKNQLGFDGFVVSDWNAHKFVEGCDLEQCAQAINAGVDVIMVPEHFEAFYHNTVKQVKEGVIAESRINDAVRRFLRAKIRWGVFTKGKPSARPESQHPQWLGANEHRTLAREAVRKSLVLLKNNENVLPIKAHSRILVAGKGANAINMQAGGWSVSWQGTDNTNSDFPNATSIYAGLKSQVLKAGGEISLSESGDYKTKPDVAIVVIGEEPYAEWFGDIEMLEFQHESKHALALLKKLKADNITVVTVFLSGRPLWVNKELNASDAFVAAWLPGSEGEGVADVLLTDKNGNSQFDFSGKLSFSWPKYDDQFSLNLGDVNYDPLFAYGYGLTYQDTVNIPVVSETTSPKKIVKSDAHPLFVKSLAKNLTWALADTTAKVLTSGSSATSGDKKSLLMQSVNLSYQEDARQFKWQSQSSDATLSLSYLKPTLLERKFKSGYLELKMRLDKAPEQGAQLQVMCNLDNCLRSIDFSSFEKTMADKRWHTLSIALNCADSELIEQSMSDVIRISAQRLSLAVADIALTAKPNNDALSITCSK

SEQ ID NO: 165 - DNA, 1005 bp, Unknown
  Obtained from an environmental sample
atgtcaaaggcgaaactttatgtcatactgttatttttctctgttgttgcaagcggttttgatttatcgcgtcaaaaagcctttgagtacaacaaacatcttggagttggtgttaatcttgggaacgctcttgaggctccaagagaaggtgcttggggaatgagaattcaagatgattattttcctgcgatcaaagaaaggggtttcaatcatgtcagaattcctatccgatggtccgcacactgtattaaagagccaccttacacaatagatgaaaagtttttccaaagagttgaacatgttattcaaaaggcacttgaaaatggcttgttggttgttataaacatgcatcactttgaagagctttatcaaaatccgctacaatacaaggagatattcttggctctttggcaacaaatttcagagagattcaaggattatccagctgaactgagttttgagattttcaatgaaccagctcaagcttttactgtgtcactctggaatcaatttgcacgcgaagctctcaaagttatacgtcagtctaatccagaacgaatagtgataatcgatgctccaaattgggctcattggagtgccgttgagactcttgcactgccagaagatgaaaacatcatagtttcttttcactactatgaacctttcaattttacccatcaaggtgccgaatgggtttcaccagttccacgcgtgggtgtgaagtgggaagccacaaaagcccaaattggtgaaatcgagaagcatttcaaagctgttagcgactgggcgaagaaacacaatgttccaatttaccttggggagtttggagcttactccaaagcagacatggaatctcgtgtgaaatggactaggacagtcagtcaaatagcacagaagtatggtttttcaattgcgtactgggaattcggcgcagggtttggaatttacgatcgatccaaaggcgaatggatagagcctctgacgaatgcagtgtttggtcaataa

SEQ ID NO: 166 - protein, 334 aa, Unknown
  Obtained from an environmental sample
  DOMAIN (41)...(317): Cellulase (glycosyl hydrolase family 5)
  SITE (226)...(229): N-glycosylation site. Prosite id = PS00001
MSKAKLYVILLFFSVVASGFDLSRQKAFEYNKHLGVGVNLGNALEAPREGAWGMRIQDDYFPAIKERGFNHVRIPIRWSAHCIKEPPYTIDEKFFQRVEHVIQKALENGLLVVINMHHFEELYQNPLQYKEIFLALWQQISERFKDYPAELSFEIFNEPAQAFTVSLWNQFAREALKVIRQSNPERIVIIDAPNWAHWSAVETLALPEDENIIVSFHYYEPFNFTHQGAEWVSPVPRVGVKWEATKAQIGEIEKHFKAVSDWAKKHNVPIYLGEFGAYSKADMESRVKWTRTVSQIAQKYGFSIAYWEFGAGFGIYDRSKGEWIEPLTNAVFGQ

SEQ ID NO: 167 - DNA, 1107 bp, Unknown
  Obtained from environmental sample
atgtttatcggttttcgcttatctattgcgtcgctgctggcgtgtttgcttttccccatgcaggcgttggcacaggcggaagatcctgttaccagcgatcgccaggtgtatgaaaaaattggtcgttttgattcgagcttgctaatcaatcagcaggattttattcgcgttaaaggtaatcagtttatcgacgaaaaaggagaggttttcatttttcgtggtgtaagcgtggctgacccggataaattggcgaaagaaaagcaatggaaaaaaagtttatttgcagagttaaaaaattggggtgtgaataccgtacgtttaccgattcatcctcgagcctggcgtgaacgtgggcaggaagaatacttcaaattgattgatcaggcggtaatgtgggccaatgagtttgatcaatatctgattcttgactggcattccattggttatctcgccagcggaaattatcaacatcccatgtataccaccgacaaacaagagacctttcgcttttggctggatgtggcctatcgttatcaaggggttccgactacagcggtgtatgagttatttaacgagccgactaccttggataaaccttggggtaaaatcgagtgggctgaatggaaagcacttaatgagcagatgatcgacattatctacgccattgataaaaatgttattccattggtggcaggttttaactgggcctacgatttaacaccgcttaaaggtgcgccagttgatcgtccgggtattgcttatgcgtcacatccctatccacaaaaagtacaacaagatcccgccgcgaaagaagtctttttcaaaggatgggaagagaagtggggctttgccagcaaaaaatatccgctgatttgtaccgagctgggctgggtgcagccggatggttacggtgctcatgtaccggtaaaaaatgatggcagctacggcccgcaaattattgaatatatggaagagcgcggaatttcctggacggcctgggtgtttgacccacaatggtcaccgaccatgattaatgattggaattttactccctcagaacaaggtgcgtttttcaagaaggtaatgttggagcacgccaaaaagtaa

SEQ ID NO: 168 - protein, 368 aa, Unknown
  Obtained from environmental sample
  SIGNAL (1)...(24)
  DOMAIN (60)...(343): Cellulase (glycosyl hydrolase family 5)
MFIGFRLSIASLLACLLFPMQALAQAEDPVTSDRQVYEKIGRFDSSLLINQQDFIRVKGNQFIDEKGEVFIFRGVSVADPDKLAKEKQWKKSLFAELKNWGVNTVRLPIHPRAWRERGQEEYFKLIDQAVMWANEFDQYLILDWHSIGYLASGNYQHPMYTTDKQETFRFWLDVAYRYQGVPTTAVYELFNEPTTLDKPWGKIEWAEWKALNEQMIDIIYAIDKNVIPLVAGFNWAYDLTPLKGAPVDRPGIAYASHPYPQKVQQDPAAKEVFFKGWEEKWGFASKKYPLICTELGWVQPDGYGAHVPVKNDGSYGPQIIEYMEERGISWTAWVFDPQWSPTMINDWNFTPSEQGAFFKKVMLEHAKK

SEQ ID NO: 169 - DNA, 1113 bp, Unknown
  Obtained from environmental sample
atgcgctgcccttcacttttatctattaaaaacctactcgccctgatcggcatccttttgactgcgccggtgtttgcacaagcggaagatccggtggccagtgatcgcaagacttatgaaaaagtcggtcgctttgacgcgaaccagttgaaaaacaaacaggacactatccgcgtaaaagatcatcagtttgtcgatgagcaaggcaaggcttttatctttcgtggtgtaagcgtggccgatccggataagttggtgaaagacaagcaatggaaagccagcctgttcaaagagctgaaagcctggggcgcaaataccgtacgcttgccgattcatccgcgcacctggcgcgagcgcggacaggatgaatatctcaaactgatcgaccaggcggtaatctgggcgaaccagcaccagctgtatctgatcctcgattggcattccatcggtttcctcgcgtccggcaactatcaacacccgatgtattacaccgacaaacaggaaaccttccgtttctggcacgacatcgcctaccggtatcaaggcgtgccaaccacagcggtgtatgaattatttaacgaaccgacaaccttgcaagatccttggggtaaaaccgagtgggcggaatggaaaacgctgaatgagcagatgatcgatgtcatttatgccattgataaagatgtcattccgttggtcgcgggctttaactgggcctatgatctgacgcccatcgccgatgcgcctgttgatcgtccaggcgtggcttacgcgtcccatccttatccgcaaaaggagcagcccaccccaccgacgaaagaaaatttctttaaagcctgggatgcgaagtggggctttgccagcaagaaatatccgttgatttgcactgaactgggttgggtgcagcccgacggctacggtgcccatgtgccggtgaaaaatgatggcagttacgggccgcaaattattgagtttatggaagcgcgcggcatctcctggacggcctgggtatttgatccgcagtggtcgccgaccatgatcaatgactggtcgtttacgccgtcggagcagggggcgttttttaagaaggtgatgcaggaaaaggcggggaaatga

SEQ ID NO: 170 - protein, 370 aa, Unknown
  Obtained from environmental sample
  SIGNAL (1)...(26)
  DOMAIN (62)...(345): Cellulase (glycosyl hydrolase family 5)
MRCPSLLSIKNLLALIGILLTAPVFAQAEDPVASDRKTYEKVGRFDANQLKNKQDTIRVKDHQFVDEQGKAFIFRGVSVADPDKLVKDKQWKASLFKELKAWGANTVRLPIHPRTWRERGQDEYLKLIDQAVIWANQHQLYLILDWHSIGFLASGNYQHPMYYTDKQETFRFWHDIAYRYQGVPTTAVYELFNEPTTLQDPWGKTEWAEWKTLNEQMIDVIYAIDKDVIPLVAGFNWAYDLTPIADAPVDRPGVAYASHPYPQKEQPTPPTKENFFKAWDAKWGFASKKYPLICTELGWVQPDGYGAHVPVKNDGSYGPQIIEFMEARGISWTAWVFDPQWSPTMINDWSFTPSEQGAFFKKVMQEKAGK

SEQ ID NO: 171 - DNA, 1341 bp, Unknown
  Obtained from an environmental sample
  misc_feature (1)...(1341): n = A,T,C or G
atgagcattcaacgcgacgactttcccgccgacttcgtgtggggcaccgccaccgccgcctaccagatcgagggggcggtagacgaggatggccgcgcccccagcatctgggacaccttcagccacacccctggcaagacccgcgacggtgataccggcgacaccgcttgcgaccactaccaccgctaccgcgaggacgtggccctgatgcgggagctgggcgtcaacggctaccgcttctccatcgcctggccgcgcgtgctgccccaggggcgcggtgtggtcaacggggccgggctcgacttctacgaccgcctggtggatgcgctgctgggagccgggatcaccccctgggctacgctctaccactgggatttgccccaagccctcgaggacgcgggcggctggccccggcgcgacaccgcctacgccctggccgagtacgccgccgtggtggggcggcgcctgggcgaccggctcaagcgctggatcaccctcaacgagccgtggtgctcggcctacttgggctacggcaacggggtgcacgcgcctggtcgccaggacttcgccctctccttgcaggctgcccaccacctgctgctggggcacggcctggcgacagaggcgctgcgggcggcggtgcccggggctcaggtgggggtcaccctcaacctcacccccacccacccggccacgcccgatccccgcgacctcgaggccgcccgccgctacgacggcttcttcaaccgctggtacctcgacccgctgttcggtttcggctacccgctggacatgtgggagctntacgggcggatggtgccccacgtagagccggaggacctgaggcgcatcgcgttctctcgattcctgggcatcaactactactcgcgttcggtggtgcggcacgcggagcagggtcccctgctcgtcgagcacgtgcgcccggagggcgagtacacctacatgaactgggaggtctatcccgatggcatccgcgagatcgtggcgcgggtggcccgcgagtaccggccacgttccatttacatcaccgagaacggggcctgctatcccgacggggtggaggacgacggggaaatccacgactccaagcgcctggagtactaccgttcccacctcagcaagtgcgcccaggccatccgcgagggggcgccgctgaagggctacttcgcctggagcctgctggacaacttcgagtgggccgagggctacgacaagcgctttgggctgttctatgtcaacttcgccacccaggagcgccgcctcaagcagagcgggcgctggctgaagggcttcctcgagggcgctgcggaggccggttga

SEQ ID NO: 172 - protein, 446 aa, Unknown
  Obtained from an environmental sample
  DOMAIN (4)...(444): Glycosyl hydrolase family 1
  SITE (12)...(26): Glycosyl hydrolases family 1 N-terminal signature. Prosite id = PS00653
  SITE (352)...(360): Glycosyl hydrolases family 1 active site. Prosite id = PS00572
MSIQRDDFPADFVWGTATAAYQIEGAVDEDGRAPSIWDTFSHTPGKTRDGDTGDTACDHYHRYREDVALMRELGVNGYRFSIAWPRVLPQGRGVVNGAGLDFYDRLVDALLGAGITPWATLYHWDLPQALEDAGGWPRRDTAYALAEYAAVVGRRLGDRLKRWITLNEPWCSAYLGYGNGVHAPGRQDFALSLQAAHHLLLGHGLATEALRAAVPGAQVGVTLNLTPTHPATPDPRDLEAARRYDGFFNRWYLDPLFGFGYPLDMWELYGRMVPHVEPEDLRRIAFSRFLGINYYSRSVVRHAEQGPLLVEHVRPEGEYTYMNWEVYPDGIREIVARVAREYRPRSIYITENGACYPDGVEDDGEIHDSKRLEYYRSHLSKCAQAIREGAPLKGYFAWSLLDNFEWAEGYDKRFGLFYVNFATQERRLKQSGRWLKGFLEGAAEAG

SEQ ID NO: 173 - DNA, 2205 bp, Unknown
  Obtained from environmental sample
atgaagagtgttttagcattggccttaatagtttccattaatttggttttattagcaaattctgtattaattccgccaaatatcgacgattctttcttatacggtaacgaacttgtgaagaaaccttcggaagccggggctttgcgagttattgagtataacgggataaaaaccttgggagatgaagaaggtaatcctattcaattaaggggtatgagcacgcacgggcttcaatggttccccgaaattctaaacgaaaatgctttcgccgctcttgcaaatgattgggaagcgaatgtaattcgccttgccatgtatgtgggagaagacggatacgcaacagatcctgaaaccatcaaaaaaagagtcattcaaggaatcgatcttgcaaagaagtacgatatgtacgtgatcgtagattggcacgtacatgcaccaggagatccaactgatccaatatatgagggagcacaggaattctttaaagaaatttcagaattgtatcctaatgaccctcatatcatctatgaattatgtaacgaaccaaatggtatcccaaatgatgaaaccggttggcaaattgtaaaagattatgcagaacctattattgaaatgcttcgggaaaacgggaatgaaaacatcgttattgttggaaatcctaattggagccaaagacctgatttagctgctgatgatccaatcgatgatcaaaataccgtttacacccttcatttttatgcaggtacccataaaccgtcaccagatagttacgtaatgaaaaatgcaatttatgcattgaagcacggtgcccctatttttgtatctgaatggggaacaagcgaagctactggcgatggtggaccatatatagaagaatcagatgaatggcttaagtttttgaacgccaataacgttagttgggttaattggtctcttactaataaaaatgaaaaatctgcggcatttacaccatacgtatatggtgaatctgaagcaacagatcttgatccaggacctgatcaaatatggtcaccagaggaactaagtatttcaggagaatatgttcgtacacgtataaaaggtgtagaatacgaaccaattgaccgttcaaattactacaaaacattatgggattttgatgatgggacaactcaaggctttgtagtaaattccgacagtcctgtcactgatgtatcgttgaccaatgaggataatagattaaaaatttctggtttagatgcaagcgatgacgttagcgaaggaggattttggaacaatcttcgtatttctgcggataattggggcaacgcagttgatattaccggggctggaaaaataatgatagatgttattttaaaatctcctgcaactgttgctatagcagtgattcctcaaggacccgggaatggctggtggactaatcctgctcgcgctgtaaggctcaccccaaatgattttgtcaaacaagttgatggaacttacaaagcagttctaacaattacggctgaagatagcccgggcttggaaacaattggcacgagtgacacagacaatacgattcaaaatatcgtccttttcgtaggtacagagggagcagatgtaatttatttggataattttaaggtttctggcaaaaaaattgaaattcccattatccatgatccgttaggtgaagcaaaattaccgtcggattttgaagatggtactcgccagggttggaaatggagtagtgactcagcagtgcaaacagctcttaccattgaagaagccaacggttcaaaagctttatcttgggaagtagcttatcctgaagtaaagccaagtgatacgtgggcatccgcaccacgtttagatttctggatggatggtctaaaacgcggggataaaaatttcttgttttttgatttttatttagctcccgatagagcttccgaaggaattattgaaataaatttggcgtttcaaccatcatcagcaggttattgggcacaggcaaccgatacttatgaaattgatttatcagatcttgattcaacaactgtaacaaatgatggcctgtaccattatgaagtaaaaatagatttaaattcagttcccaatattgaagacaacactgatttaagaaatatgcttttaatttttgttgatgtaaacagcgacttcgctggaagaatgtatatagataatgtcaattttattgaataa

SEQ ID NO: 174 - protein, 734 aa, Unknown
  Obtained from environmental sample
  SIGNAL (1)...(19)
  DOMAIN (57)...(320): Cellulase (glycosyl hydrolase family 5)
  DOMAIN (342)...(543): Carbohydrate binding domain (family 17/28)
  DOMAIN (544)...(733): Carbohydrate binding domain (family 17/28)
  SITE (176)...(185): Glycosyl hydrolases family 5 signature. Prosite id = PS00659
  SITE (224)...(227): N-glycosylation site. Prosite id = PS00001
  SITE (308)...(311): N-glycosylation site. Prosite id = PS00001
  SITE (313)...(316): N-glycosylation site. Prosite id = PS00001
  SITE (395)...(398): N-glycosylation site. Prosite id = PS00001
  SITE (600)...(603): N-glycosylation site. Prosite id = PS00001
MKSVLALALIVSINLVLLANSVLIPPNIDDSFLYGNELVKKPSEAGALRVIEYNGIKTLGDEEGNPIQLRGMSTHGLQWFPEILNENAFAALANDWEANVIRLAMYVGEDGYATDPETIKKRVIQGIDLAKKYDMYVIVDWHVHAPGDPTDPIYEGAQEFFKEISELYPNDPHIIYELCNEPNGIPNDETGWQIVKDYAEPIIEMLRENGNENIVIVGNPNWSQRPDLAADDPIDDQNTVYTLHFYAGTHKPSPDSYVMKNAIYALKHGAPIFVSEWGTSEATGDGGPYIEESDEWLKFLNANNVSWVNWSLTNKNEKSAAFTPYVYGESEATDLDPGPDQIWSPEELSISGEYVRTRIKGVEYEPIDRSNYYKTLWDFDDGTTQGFVVNSDSPVTDVSLTNEDNRLKISGLDASDDVSEGGFWNNLRISADNWGNAVDITGAGKIMIDVILKSPATVAIAVIPQGPGNGWWTNPARAVRLTPNDFVKQVDGTYKAVLTITAEDSPGLETIGTSDTDNTIQNIVLFVGTEGADVIYLDNFKVSGKKIEIPIIHDPLGEAKLPSDFEDGTRQGWKWSSDSAVQTALTIEEANGSKALSWEVAYPEVKPSDTWASAPRLDFWMDGLKRGDKNFLFFDFYLAPDRASEGIIEINLAFQPSSAGYWAQATDTYEIDLSDLDSTTVTNDGLYHYEVKIDLNSVPNIEDNTDLRNMLLIFVDVNSDFAGRMYIDNVNFIE

SEQ ID NO: 175 - DNA, 1809 bp, Unknown
  Obtained from environmental sample
atgacatttgaaaaaccaatcttcgaacgctttcgtttgccaagttgcaagccggtcattttaggcctgctgtcattggcgcttgcagcctgtggcggtgttcccgggaacgagactgacaatgccggggtatcgtcaaatgatggttctagcttatcgtcgtccagcttaaactcttcatccagttcaagcaccgtatccagttcaagctcgtccttaagctcaagccctttggttagctcgatctctgtatccagctcaagttcatcaatcagttccagttcgtcgattagctcaagttcattaagcagttcaagctcgtcgattagctcaagctcatccatcagctcaagttcggtgtctagctcaagctcatcaatcagttcgagttcatcgtccagctccacatccagttctgacgacagccgcgtggtagaggcagaatccctcaacccgaatcaatcctctgactacatgttggtcgtatccgagagcgatccgcgcctagaatatgtcggctattttgatgccggaagctatatttgttacgacaacattgacctgaccggcgtgcgcagcattgatatgcaatacgccaaaggcatgagccaaaatggccgttttgcggtcattatcaatggcaacagtctgggctctggcactaacctcggcgaaaagatcacccgcccaacttctagctccaccgccgactgggaatcatttaccagtttacgcgtcggcttatctcaacaagtcagtggtactcatcgcctgtgctttgtcgggctaaacggcggcggaatattcaacctggataaattcaccttgagtgatagcaccggggaaaacgacggtattacgcctccgcccagcagtggcacagcgccccctcccgctcctggcgacaacacggttagccaaggggttttgccgatcactacgagcggcaaccaagtgctttttggtggccaaccgggcagcattgctggcatgagtttgttctggagcaacaacaactggggcggtgagcggttttacaacgccgacgtggtgcgctggttgaagcaggattggaatatcaaactgatacgtgccgccatgggcgtaggcaccgagcccggtggttacattcaaagcccaggccccaaccgccagcgcgtgcagaccattgtagatgcggctattgccaatgacctctatgtgatcatcgactggcacgcccacgcagcggaaaactatactgatcaggccattgccttctttactgacatggcgcggcagtatgggcagtacaacaatattatctacgaaatctacaatgagcctctgcagaatacctcgtgggacaacaccatcaaaccttatgcggagcgggtcattgccgccattcgtgcgatcgatccagataacctgatcatcgtgggcacccgctcctggtctcagcgggttgatgaagctgcggccaatcctattcgcaactaccctaatattgcatacaccttgcacttctactctggcacccacaaacaagccattcgcaattatgcgaccacagcgctgaacaacggaattccgctctttgttaccgaatggggcacaaccgatgctagcggagacggggctgtggatgtcgccgaaacgcgaatttggatggattttttgcgcgccaacaacatcagtcacgccaactggtcgctgaacgataaggccgaaggctcagctgcattgcgccccggtgccagcactactggaggctggagtaacaacgacctgaccgaatccggccgattggtgcgagattacattcgc

SEQ ID NO: 176 - protein, 603 aa, Unknown
  Obtained from environmental sample
  SIGNAL (1)...(36)
  DOMAIN (316)...(574): Cellulase (glycosyl hydrolase family 5)
  SITE (37)...(40): N-glycosylation site. Prosite id = PS00001
  SITE (58)...(61): N-glycosylation site. Prosite id = PS00001
  SITE (155)...(158): N-glycosylation site. Prosite id = PS00001
  SITE (418)...(421): N-glycosylation site. Prosite id = PS00001
  SITE (440)...(449): Glycosyl hydrolases family 5 signature. Prosite id = PS00659
  SITE (451)...(454): N-glycosylation site. Prosite id = PS00001
  SITE (566)...(569): N-glycosylation site. Prosite id = PS00001
  SITE (571)...(574): N-glycosylation site. Prosite id = PS00001
MTFEKPIFERFRLPSCKPVILGLLSLALAACGGVPGNETDNAGVSSNDGSSLSSSSLNSSSSSSTVSSSSSSLSSSPLVSSISVSSSSSSISSSSSISSSSLSSSSSSISSSSSISSSSVSSSSSSISSSSSSSSTSSSDDSRVVEAESLNPNQSSDYMLVVSESDPRLEYVGYFDAGSYICYDNIDLTGVRSIDMQYAKGMSQNGRFAVIINGNSLGSGTNLGEKITRPTSSSTADWESFTSLRVGLSQQVSGTHRLCFVGLNGGGIFNLDKFTLSDSTGENDGITPPPSSGTAPPPAPGDNTVSQGVLPITTSGNQVLFGGQPGSIAGMSLFWSNNNWGGERFYNADVVRWLKQDWNIKLIRAAMGVGTEPGGYIQSPGPNRQRVQTIVDAAIANDLYVIIDWHAHAAENYTDQAIAFFTDMARQYGQYNNIIYEIYNEPLQNTSWDNTIKPYAERVIAAIRAIDPDNLIIVGTRSWSQRVDEAAANPIRNYPNIAYTLHFYSGTHKQAIRNYATTALNNGIPLFVTEWGTTDASGDGAVDVAETRIWMDFLRANNISHANWSLNDKAEGSAALRPGASTTGGWSNNDLTESGRLVRDYIR

SEQ ID NO: 177 - DNA, 1218 bp, Unknown
  Obtained from environmental sample
atgttggtttatagagtttcaattcaaaagcacttggcgtcactaacggtactcgtttcgctgctgttaattctcgccggttgctccagctcgagcgattccatagccccagtgtcatcctccagtgtgtctagcgctgccagctctgtcggcgagatgcctgcgccggttcccattacccccgcgggcgagccgattactgcgctggatgccgccgcggagatgggcgctggttttaacctcggtcaaatgtttgataacactcagcatgcgcgcacattttatgcggcgcagcccaaaattgatgcctactatgagttgggctatcgcaatctgcgcatcccaattacctggaccgatattgtcggtggcgaccgtttggtcaatgatcccgatgtgggggatgtggattttgatcatccgcgcttaaacgagattgcccagattattgattatgcgctctcgctgtccgacatgtacgtgattattaatgcgcaccacgagcgcgatttgaagaacgataataaatggcaggtattggaacggttgtggttggatatagcgacccattttggcgatcgcgattatcggctgatgttccaactgctcaacgagccccatttgaataatgatgaccccatgccggttgccaatcttcgatttatgagtggcaaagcctacgatatgattcgggcggtgaacgccaaacgtattgttatcattggcggcaatcaatggtttgccgccgatgaaatggcgcgggtctggccagatttacaaccggtgggcggtggtgaagatccctacgttatggccagttttcaccactataacccctgggagttttccggcgacaaccaagacgattacgcctacccctggactgaagaccacttaacgtcacctatagacactatgctcgagtggtcacaaaatatgggcaacggcatgccgatctatattagcgagtggggtgtcggatggcagagcaccttggccgtgatggattgcaataatatccgggaatggtacgcccagatgcacgttcaccacgccgcacccaagggcatccctacctctgtctgggatgatggcggctggttccgaatttttgatcacagcagtaatgtttttgacaatgaactggccacttgtttgattgatggccaatgcgattggagcggaacagagcgctttaatatgggatgtttccgctag

SEQ ID NO: 178 - protein, 405 aa, Unknown
  Obtained from environmental sample
  SIGNAL (1)...(46)
  DOMAIN (67)...(370): Cellulase (glycosyl hydrolase family 5)
  SITE (201)...(210): Glycosyl hydrolases family 5 signature. Prosite id = PS00659
MLVYRVSIQKHLASLTVLVSLLLILAGCSSSSDSIAPVSSSSVSSAASSVGEMPAPVPITPAGEPITALDAAAEMGAGFNLGQMFDNTQHARTFYAAQPKIDAYYELGYRNLRIPITWTDIVGGDRLVNDPDVGDVDFDHPRLNEIAQIIDYALSLSDMYVIINAHHERDLKNDNKWQVLERLWLDIATHFGDRDYRLMFQLLNEPHLNNDDPMPVANLRFMSGKAYDMIRAVNAKRIVIIGGNQWFAADEMARVWPDLQPVGGGEDPYVMASFHHYNPWEFSGDNQDDYAYPWTEDHLTSPIDTMLEWSQNMGNGMPIYISEWGVGWQSTLAVMDCNNIREWYAQMHVHHAAPKGIPTSVWDDGGWFRIFDHSSNVFDNELATCLIDGQCDWSGTERFNMGCFR

SEQ ID NO: 179 - DNA, 2313 bp, Unknown
  Obtained from an environmental sample
atgaaaaaaagaattatttcagcgggcttaacctttttgataggtgtttcgttacaggctcaaagtgaaaatttcacgattataaaaaacaataaaggagccgatttaggatattctcccgaatcgggtattaaaattataaccattaacggaaagaaatttaaagatttaaataaaaacggaaaacttgataaatatgaagattggcgactttcggcagatgaaagagccaaagatttagcctcgcaaatgtccgtagagcaaatagcaggattgatgctttacagtcgtcatcaatctttgccagcaggaacttcaggttttatggcaggaacatataatggaaaaccatttacggagcgtaatgcaaaagcttacgatttaacagatcagcaaatggcttttttgaaagatgataaccttcgtcatgtcttaatcacaagcgtcgaaagccctgaaacagctgctttatggaacaataaaatgcaggcttttgtagaagatattggcttaggaattccgagtaatacaagtacagatccgcgtcataatgctgttgtaacggctgagtttaatgcaggagcaggagggaccatatcgatgtggcctgacggtttaggaatggcagctacttttgacccaaaaatagtagaacagtttgggcaaattgctgccaaagaatatcgcgctttaggaatcgcaactgcactttcgccacaaatagatttaggttcagagccaagatggtatagaatttcgatgacttttggcgaaagcccggctttaaccagagatatgggacgtgcttatattgacggttttcaaacttcatacggaaaagacgaaattaaagacggttggggttacaaaagtgtaaatgcaatggttaaacactggccaagtggtggagccgaagaaggcggtcgtgacggacattgggcttacggaaagtttgcggtatatcccggaaataatttgcaacagcatattaatccttttgtaaatggcgctttcaaattaaaaggaaaaaccggtaaagcttcggctgtaatgccatattacacgatcacttttaatcaggataaaaagtacaatgaaaatgtggcaaacggttacagtaaatatattattacagatttattaagagataaatacggttacgatggtgttgtttgtacagattggttaattactgctgatgaaggaaaaacaccaaatgtatttgccggaaaaccttggggcgtagagaatctttcgattgccgaaagacattacaaagcaattattgcaggtgtagaccaatttggtggaaacaatgataaaaaacctgttctcgaagcctatgatatgggagtaaaagaatatggagaatcattcatgagagctcgttttgaaagatcagcagtacgattattaaagaatatttttagagttggtctttttgaaaacccatatttaaatgttgccgaaacaaaagcaattgtcggaagtcctgaatttatgaaagcgggatatgatgcgcaattaaaatcggtagtgttgttaaaaaataaaacttcacttcttccgataaaagaaaagaaaaccgtttttattccaaagatttataccgcttctactaaggattggtggggaattccaagtcagccaaaacttgattatccggtaaatcttgaattggtaaaaaaatattataatgttaccgaagatccttcaaaagcagattttgcgattgtttttgtaacaagtccgcaaagtttagaaggtggttatgatttgaaagacagacaaaacggaagcaatggttatgtgccaatttcgcttcaatacggaacttatacagcaaccgaagccagagcaaaaagtattgctgccggagatcaggttattgatccaacaatcaaagacagaacttataaaaacaaaaccgttaccgttgcaaatacaatggatttaagaacgattttggatacaaaagatatgatgaacggaaaaccggttattgtttcggttacggcttcaaagccaatgatctttgatgaattcgaaaaacaagttgacggaattgtattgaattttggagtttcgacacaggctgttttagatattatctccggaaaaatagaaccatcaggattgcttccggttcagatgccggcaaatatggaaacggttgaaaaacaatttgaagacgttccttatgatatgattccgcataaagacagcgaaggaaatgtttatgattttgcttatggattaaactggaaaggtgttataaaagataccagaactgaaacttataagaaacagtaa

SEQ ID NO: 180 - protein, 770 aa, Unknown
  Obtained from an environmental sample
  SIGNAL (1)...(22)
  DOMAIN (165)...(437): Glycosyl hydrolase family 3 N terminal domain
  DOMAIN (512)...(757): Glycosyl hydrolase family 3 C terminal domain
  SITE (24)...(27): N-glycosylation site. Prosite id = PS00001
  SITE (178)...(181): N-glycosylation site. Prosite id = PS00001
  SITE (423)...(426): N-glycosylation site. Prosite id = PS00001
  SITE (524)...(527): N-glycosylation site. Prosite id = PS00001
  SITE (574)...(577): N-glycosylation site. Prosite id = PS00001
  SITE (607)...(610): N-glycosylation site. Prosite id = PS00001
  SITE (650)...(653): N-glycosylation site. Prosite id = PS00001
MKKRIISAGLTFLIGVSLQAQSENFTIIKNNKGADLGYSPESGIKIITINGKKFKDLNKNGKLDKYEDWRLSADERAKDLASQMSVEQIAGLMLYSRHQSLPAGTSGFMAGTYNGKPFTERNAKAYDLTDQQMAFLKDDNLRHVLITSVESPETAALWNNKMQAFVEDIGLGIPSNTSTDPRHNAVVTAEFNAGAGGTISMWPDGLGMAATFDPKIVEQFGQIAAKEYRALGIATALSPQIDLGSEPRWYRISMTFGESPALTRDMGRAYIDGFQTSYGKDEIKDGWGYKSVNAMVKHWPSGGAEEGGRDGHWAYGKFAVYPGNNLQQHINPFVNGAFKLKGKTGKASAVMPYYTITFNQDKKYNENVANGYSKYIITDLLRDKYGYDGVVCTDWLITADEGKTPNVFAGKPWGVENLSIAERHYKAIIAGVDQFGGNNDKKPVLEAYDMGVKEYGESFMRARFERSAVRLLKNIFRVGLFENPYLNVAETKAIVGSPEFMKAGYDAQLKSVVLLKNKTSLLPIKEKKTVFIPKIYTASTKDWWGIPSQPKLDYPVNLELVKKYYNVTEDPSKADFAIVFVTSPQSLEGGYDLKDRQNGSNGYVPISLQYGTYTATEARAKSIAAGDQVIDPTIKDRTYKNKTVTVANTMDLRTILDTKDMMNGKPVIVSVTASKPMIFDEFEKQVDGIVLNFGVSTQAVLDIISGKIEPSGLLPVQMPANMETVEKQFEDVPYDMIPHKDSEGNVYDFAYGLNWKGVIKDTRTETYKKQ

SEQ ID NO: 181 - DNA, 1707 bp, Unknown
  Obtained from environmental sample
atgaaaagaactattttgagatttagtaaattcttaaaaatagtgattttaattactttcactttgcaaatatttactgtgtttgctaagaatacaccatatgaaagtaggaaatatccacaccttcttggcaaccaagcggtgaaaaaaccatcagttgctggcaggctccagattattgaaaaggacggtaaaaagtatttagctgaccagaaaggcgaaataattcagcttcgtggtatgagtacgcatggactccagtggtatggtgacattgtaaacagaaatgcgtttgctgctctttcaaaagattggggatgcaatgttataaggcttgcgatgtatgtgggtgaaggtggttatgcttcaaatccaggcattaaagaaaaagttgtaaagggaataaaacttgcaattgaaaatgacatgtatgtgattgttgactggcatgtgttaaatccaggcgacccgaatgctgaaatttataaaggggcaaaagactttttcaaggagatagctacaagttttcccaatgactatcacataatatatgaactttgtaatgaaccgaatccaaatgagccgggagtagaaaatagcttggatggttggaaaaaggtaaaggcttatgctgaacccatcataaaaatgctcagaagcttggggaatcagaacattataattgtaggttcgcccaattggagccagagacctgactttgcaattcaagaccctataaacgacaaaaatgttatgtattcagttcatttttattctggtactcacaaggttgatgggtatgtttttgaaaacatgaaaaaggcatttgaaaatggtgtgccaatttttgtgagtgaatggggaacaagtttggcaagcggtgatggtggaccatatcttgatgaggcggataagtggcttgagtatttaaatgcaaactatattagctgggtgaactggtcactgtcaaacaaaaatgaaacatcagctgcttttgtctcgtatgttagtggcatgcatgatgccacatcacttgatcctggcgatgataagatgtgggatataaaagagctgagtatatctggagagtatgtgagagcaaggataaaagggattgcatataaccctataaagagagacaaaggaataaaatgtccttttaaagatctcaatgaagataatattttttatgaacaagtagtaaaactttattcaaaaggaattataaaaggtactttatcttctaagtatttgcctgataaaaacatcacaagggctgaacttgctgcactatgtgtaagattattgaatctgaaaattgaaaaatatgacggcaggttttctgatgtaaaaagtagtgactggtacgcagatgtggtttatacagcatataaaaatggtttgtttaaacaagaagaagaaaagagatttttccctgaaagaatcactaaaagagaagaagtagctgctttggcaatcgaagtatacaaaagattgataggtaaattagaggttgacgtggatgatattcaagttgtcgacgaagaccttataaagcctcaatatagagagtgtgtgaaattagcagtttatcttggtattattgacttagattcagacggaacctttgtaccaagtaagagcgtttcgagaggggaggcagcaacaattttttataatgttttgaacttagcaggcaagctatga

SEQ ID NO: 182 - protein, 568 aa, Unknown
  Obtained from environmental sample
  SIGNAL (1)...(29)
  DOMAIN (66)...(330): Cellulase (glycosyl hydrolase family 5)
  DOMAIN (352)...(565): Carbohydrate binding domain (family 17/28)
  DOMAIN (387)...(429): S-layer homology domain
  DOMAIN (447)...(489): S-layer homology domain
  SITE (184)...(193): Glycosyl hydrolases family 5 signature. Prosite id = PS00659
  SITE (236)...(239): N-glycosylation site. Prosite id = PS00001
  SITE (323)...(326): N-glycosylation site. Prosite id = PS00001
  SITE (331)...(334): N-glycosylation site. Prosite id = PS00001
  SITE (428)...(431): N-glycosylation site. Prosite id = PS00001
MKRTILRFSKFLKIVILITFTLQIFTVFAKNTPYESRKYPHLLGNQAVKKPSVAGRLQIIEKDGKKYLADQKGEIIQLRGMSTHGLQWYGDIVNRNAFAALSKDWGCNVIRLAMYVGEGGYASNPGIKEKVVKGIKLAIENDMYVIVDWHVLNPGDPNAEIYKGAKDFFKEIATSFPNDYHIIYELCNEPNPNEPGVENSLDGWKKVKAYAEPIIKMLRSLGNQNIIIVGSPNWSQRPDFAIQDPINDKNVMYSVHFYSGTHKVDGYVFENMKKAFENGVPIFVSEWGTSLASGDGGPYLDEADKWLEYLNANYISWVNWSLSNKNETSAAFVSYVSGMHDATSLDPGDDKMWDIKELSISGEYVRARIKGIAYNPIKRDKGIKCPFKDLNEDNIFYEQVVKLYSKGIIKGTLSSKYLPDKNITRAELAALCVRLLNLKIEKYDGRFSDVKSSDWYADVVYTAYKNGLFKQEEEKRFFPERITKREEVAALAIEVYKRLIGKLEVDVDDIQVVDEDLIKPQYRECVKLAVYLGIIDLDSDGTFVPSKSVSRGEAATIFYNVLNLAGKL

SEQ ID NO: 183 - DNA, 2268 bp, Unknown
  Obtained from environmental sample
atgagagaaattattttaaagtctggtgcactcttgatggtagttattttgattgtttctattttgcaaattttaactgtgtttgcccagagcacaccatatgaaaatgaaaaatatccacaccttcttggcaaccaagcggtgaaaaaaccatcagttgctggcaggctccagattattgaaaaggacggtaaaaagtatttagctgaccagaaaggcgaaataattcagcttcgtggcatgagcacgcatggactccagtggtatggtgacattgtaaacagaaatgcgtttgctgctctttcaaaagattggggatgcaatgttataaggcttgcgatgtatgtgggtgaaggtggttatgcttcaaatccaggcattaaagaaaaagttgtaaagggaataaaacttgcaattgaaaatgacatgtatgtgattgttgactggcatgtgttaaatcccggcgacccgaatgctgaaatttataaaggggcaaaagactttttcaaagagatagctacaagttttcccaatgactatcacataatatatgaactttgtaatgaaccgaatccaaatgagccgggagtagaaaatagcttggatggttggaaaaaggtaaaggcttatgcgcagtccatcataaaaatgctcagaagtttggggaatcagaacattataattgtaggttcgcccaattggagccagagacctgactttgcaattcaagaccctataaacgacaaaaatgttatgtattcagttcatttttattctggtactcacaaggttgatgggtatgtttttgaaaacatgaaaaaggcatttgaaaatggtgtgccaatttttgtgagtgaatggggaacaagtttggcaagcggtgatggtggaccatatcttgatgaggcggataagtggcttgagtatttaaatgcaaactatattagctgggtgaactggtcactgtcaaacaaaaatgaaacatcagctgcttttgtcccgtatgttagtggcatgcatgatgccacatcacttgatcctggcgatgataagatgtgggatataaaagagctgagtatatctggagagtatgtgagagcaaggataaaagggattgcatatgaaccaattgagagggatagccaaataaaagaaggacaaagtgcacctttgggtgaaaaagttttaccatccacgtttgaggatgacacgcgccagggttgggactgggatggtccgtctggtgtgaaaggacctattaccatcgaaagtgtaaatggttcaaaagcgctatcttttgaggttgagtatccagagaaaaaaccgcaagatggctgggcaacagctgcaagacttatacttaaggaaataaatgcgaagagagaagataataagtatcttgcatttgacttttatataaaaccagaaagagcgtcaaaaggtgagattgagatatttttagctttttcaccaccttccttaggttactgggctcaagtacaagacagttttaatattgacctctcaaagctttcaagtgcaaaaaagacagaagaggggctttacaaattcaatgtattttttgacttagacaaaatccaagatggcaaagtgctaaaaccagacacgatcttgagggatattataatagtcatagcagatgggaatagcgattttaaaggaaaaatgtttatagacaatgttagattcaccaacatcctttttgaagacatcagccttgagagcagcctttatgatgctgtctccaagctttattcaaaaggaatcataaaaggagcttcagcttttaagtacttgcctgacaagaacatcacaagggctgaatttgctgcactatgtgtcagggcattgaacctgaaaattgaaaagtatgacggcaggttttctgatgtaaaaagtgacacctggtattcggatgtggtttatacggcgtataaaaacggtttgtttggacaggagaaaaatagattcttccctgaaaggattatgaaaagagaagaaacagcagctttggcaattgaagtgtacaaaagattgacaggtaaaatagaagttagcacagacgatattcaaattgccgatgaagggcttataaatcctcaatacaaagaaagcgtgaagttagctattcagctcggtattattgacctgtattcagacggaacctttgcaccaagtaagagcgtttcgagaggggaggcagcaacaattttctataacatcttgaacttagcaggcaagctatga

SEQ ID NO: 184 - protein, 755 aa, Unknown
  Obtained from environmental sample
  SIGNAL (1)...(29)
  DOMAIN (66)...(330): Cellulase (glycosyl hydrolase family 5)
  DOMAIN (352)...(571): Carbohydrate binding domain (family 17/28)
  DOMAIN (575)...(617): S-layer homology domain
  DOMAIN (635)...(676): S-layer homology domain
  DOMAIN (699)...(742): S-layer homology domain
  SITE (1)...(4): Tubulin-beta mRNA autoregulation signal. Prosite id = PS00228
  SITE (184)...(193): Glycosyl hydrolases family 5 signature. Prosite id = PS00659
  SITE (236)...(239): N-glycosylation site. Prosite id = PS00001
  SITE (323)...(326): N-glycosylation site. Prosite id = PS00001
  SITE (331)...(334): N-glycosylation site. Prosite id = PS00001
  SITE (432)...(435): N-glycosylation site. Prosite id = PS00001
  SITE (619)...(622): N-glycosylation site. Prosite id = PS00001
MREIILKSGALLMVVILIVSILQILTVFAQSTPYENEKYPHLLGNQAVKKPSVAGRLQIIEKDGKKYLADQKGEIIQLRGMSTHGLQWYGDIVNRNAFAALSKDWGCNVIRLAMYVGEGGYASNPGIKEKVVKGIKLAIENDMYVIVDWHVLNPGDPNAEIYKGAKDFFKEIATSFPNDYHIIYELCNEPNPNEPGVENSLDGWKKVKAYAQSIIKMLRSLGNQNIIIVGSPNWSQRPDFAIQDPINDKNVMYSVHFYSGTHKVDGYVFENMKKAFENGVPIFVSEWGTSLASGDGGPYLDEADKWLEYLNANYISWVNWSLSNKNETSAAFVPYVSGMHDATSLDPGDDKMWDIKELSISGEYVRARIKGIAYEPIERDSQIKEGQSAPLGEKVLPSTFEDDTRQGWDWDGPSGVKGPITIESVNGSKALSFEVEYPEKKPQDGWATAARLILKEINAKREDNKYLAFDFYIKPERASKGEIEIFLAFSPPSLGYWAQVQDSFNIDLSKLSSAKKTEEGLYKFNVFFDLDKIQDGKVLKPDTILRDIIIVIADGNSDFKGKMFIDNVRFTNILFEDISLESSLYDAVSKLYSKGIIKGASAFKYLPDKNITRAEFAALCVRALNLKIEKYDGRFSDVKSDTWYSDVVYTAYKNGLFGQEKNRFFPERIMKREETAALAIEVYKRLTGKIEVSTDDIQIADEGLINPQYKESVKLAIQLGIIDLYSDGTFAPSKSVSRGEAATIFYNILNLAGKL

SEQ ID NO: 185 - DNA, 1128 bp, Unknown
  Obtained from environmental sample
atgagagaaattattttaaagtctggtgcactcttgatggtagttattttgattgtttctattttgcaaattttaactgtgtttgcccagagcacaccatatgaaaatgaaaaatatccacaccttcttggcaaccaagcggtgaaaaaaccatcagttgctggcaggctccagattattgaaaaggacggtaaaaagtatttagctgaccagaaaggcgaaataattcagcttcgtggcatgagcacgcatggactccagtggtatggtgacattgtaaacagaaatgcgtttgctgctctttcaaaagattggggatgcaatgttataaggcttgcgatgtatgtgggtgaaggtggttatgcttcaaatccaggcattaaagaaaaagttgtaaagggaataaaacttgcaattgaaaatgacatgtatgtgattgttgactggcatgtgttaaatcccggcgacccgaatgctgaaatttataaaggggcaaaagactttttcaaagagatagctacaagttttcccaatgactatcacataatatatgaactttgtaatgaaccgaatccaaatgagccgggagtagaaaatagcttggatggttggaaaaaggtaaaggcttatgcgcagtccatcataaaaatgctcagaagtttggggaatcagaacattataattgtaggttcgcccaattggagccagagacctgactttgcaattcaagaccctataaacgacaaaaatgttatgtattcagttcatttttattctggtactcacaaggttgatgggtatgtttttgaaaacatgaaaaaggcatttgaaaatggtgtgccaatttttgtgagtgaatggggaacaagtttggcaagcggtgatggtggaccatatcttgatgaggcggataagtggcttgagtatttaaatgcaaactatattagctgggtgaactggtcactgtcaaacaaaaatgaaacatcagctgcttttgtcccgtatgttagtggcatgcatgatgccacatcacttgatcctggcgatgataagatgtgggatataaaagagctgagtatatctggagagtatgtgagagcaaggataaaagggattgcatatgaacca

SEQ ID NO: 186 - protein, 376 aa, Unknown
  Obtained from environmental sample
  SIGNAL (1)...(29)
  DOMAIN (66)...(330): Cellulase (glycosyl hydrolase family 5)
  SITE (1)...(4): Tubulin-beta mRNA autoregulation signal. Prosite id = PS00228
  SITE (184)...(193): Glycosyl hydrolases family 5 signature. Prosite id = PS00659
  SITE (236)...(239): N-glycosylation site. Prosite id = PS00001
  SITE (323)...(326): N-glycosylation site. Prosite id = PS00001
  SITE (331)...(334): N-glycosylation site. Prosite id = PS00001
MREIILKSGALLMVVILIVSILQILTVFAQSTPYENEKYPHLLGNQAVKKPSVAGRLQIIEKDGKKYLADQKGEIIQLRGMSTHGLQWYGDIVNRNAFAALSKDWGCNVIRLAMYVGEGGYASNPGIKEKVVKGIKLAIENDMYVIVDWHVLNPGDPNAEIYKGAKDFFKEIATSFPNDYHIIYELCNEPNPNEPGVENSLDGWKKVKAYAQSIIKMLRSLGNQNIIIVGSPNWSQRPDFAIQDPINDKNVMYSVHFYSGTHKVDGYVFENMKKAFENGVPIFVSEWGTSLASGDGGPYLDEADKWLEYLNANYISWVNWSLSNKNETSAAFVPYVSGMHDATSLDPGDDKMWDIKELSISGEYVRARIKGIAYEP

SEQ ID NO: 187 - DNA, 1446 bp, Thermosphaera aggregans
  misc_feature: Thermosphaera aggregans M11TL DNA
ttgaaattccccaaagacttcatgataggctactcatcttcaccgtttcaatttgaagctggtattcccgggtccgaggatccgaatagtgattggtgggtatgggtgcatgatccggagaacacagcagctggactagtcagcggcgattttcccgagaacggcccaggttactggaatttaaaccaaaatgaccacgacctggctgagaagctgggggttaacactattagagtaggcgttgagtggagtaggatttttccaaagccaactttcaatgttaaagtccctgtagagagagatgagaacggcagcattgttcacgtagatgtcgatgataaagcggttgaaagacttgatgaattagccaacaaggaggccgtaaaccattacgtagaaatgtataaagactgggttgaaagaggtagaaaacttatactcaatttataccattggcccctgcctctctggcttcacaacccaatcatggtgagaagaatgggcccggacagagcgccctcaggctggcttaacgaggagtccgtggtggagtttgccaaatacgccgcatacattgcttggaaaatgggcgagctacctgttatgtggagcaccatgaacgaacccaacgtcgtttatgagcaaggatacatgttcgttaaagggggtttcccacccggctacttgagtttggaagctgctgataaggccaggagaaatatgatccaggctcatgcacgggcctatgacaatattaaacgcttcagtaagaaacctgttggactaatatacgctttccaatggttcgaactattagagggtccagcagaagtatttgataagtttaagagctctaagttatactatttcacagacatagtatcgaagggtagttcaatcatcaatgttgaatacaggagagatcttgccaataggctagactggttgggcgttaactactatagccgtttagtctacaaaatcgtcgatgacaaacctataatcctgcacgggtatggattcctttgtacacctggggggatcagcccggctgaaaatccttgtagcgattttgggtgggaggtgtatcctgaaggactctacctacttctaaaagaactttacaaccgatacggggtagacttgatcgtgaccgagaacggtgtttcagacagcagggatgcgttgagaccggcatacctggtctcgcatgtttacagcgtatggaaagccgctaacgagggcattcccgtcaaaggctacctccactggagcttgacagacaattacgagtgggcccagggcttcaggcagaaattcggtttagtcatggttgacttcaaaactaagaaaaggtatctccgcccaagcgccctagtgttccgggagatcgcaacgcataacggaataccggatgagctacagcatcttacactgatccagtaa

SEQ ID NO: 188 - protein, 481 aa, Thermosphaera aggregans
  DOMAIN (1)...(481): Thermosphaera aggregans M11TL protein
  DOMAIN (1)...(470): Glycosyl hydrolase family 1
  SITE (104)...(107): N-glycosylation site. Prosite id = PS00001
  SITE (387)...(395): Glycosyl hydrolases family 1 active site. Prosite id = PS00572
MKFPKDFMIGYSSSPFQFEAGIPGSEDPNSDWWVWVHDPENTAAGLVSGDFPENGPGYWNLNQNDHDLAEKLGVNTIRVGVEWSRIFPKPTFNVKVPVERDENGSIVHVDVDDKAVERLDELANKEAVNHYVEMYKDWVERGRKLILNLYHWPLPLWLHNPIMVRRMGPDRAPSGWLNEESVVEFAKYAAYIAWKMGELPVMWSTMNEPNVVYEQGYMFVKGGFPPGYLSLEAADKARRNMIQAHARAYDNIKRFSKKPVGLIYAFQWFELLEGPAEVFDKFKSSKLYYFTDIVSKGSSIINVEYRRDLANRLDWLGVNYYSRLVYKIVDDKPIILHGYGFLCTPGGISPAENPCSDFGWEVYPEGLYLLLKELYNRYGVDLIVTENGVSDSRDALRPAYLVSHVYSVWKAANEGIPVKGYLHWSLTDNYEWAQGFRQKFGLVMVDFKTKKRYLRPSALVFREIATHNGIPDELQHLTLIQ

SEQ ID NO: 189 - DNA, 1107 bp, Unknown
  Obtained from environmental sample
atgaaaggctttcgctggtgtgtactcgcagtattgatgctggcggcaacgaatctacgcgccgcctgtagctggcctgcctgggaacagtttaaacaggactacatcagcgaaagcgggcgcgttatcgatcccagtgacgcgcgaaaaattaccacctctgaagggcaaagctatgcgctgttctttgccctggctgcaaacgatcgtaaagcgttcgatctgctgctggcgtggacgcgcgataatctcgccgggggcgatttaacggccaacctgcctgcctggctgtgggggcaaaaggacaaagagacctggacggttatcgatcctaactccgcgtccgatgctgatatctggattgcctggtcgctgctggaagcggggcggctgtggaaaaatcaggactacacccgcacaggcaaggggctgcttaaacgcatcgtcagcgaggaagtggtgaaagtgccgggtctgggcttcatgctgctgccgggtaaaaccggatttgccgaagagaacgcctggcgctttaaccccagctacctcccgccacagctagcgaactatttcacccgattgggtacgccgtggaccacgcttcgtgaaaccaatctgcgtttattgctggagacggcaccgaaaggtttctccccaaactgggtgcaatatcagaaaaacagaggctggcagctcagtcaggataaatcgctggtgggcagttacgacgccattcgcgtttatctctgggtgggcatgatgaatgataaagacccgcaaaaggctcggctgcttgcacgctttaagccaatggcaacggtaacggcaaagcagggcgtaccgccggagaaagtcgatgtcgcaaccggtaaacggacggataaaggtccggtcggtttttctgcctctctgctaccttttttacagaatcgggacgcgcaggcagtgcaacgacagcgcgtcgccgatcattttcctgataataatgcctattacagctatgtactgaccctctttgggcaagggtgggatcagcatcgttttcgcttcaccacacagggtgaattaataccgaattggggccaggaatgcgcaagttcacaataa

SEQ ID NO: 190 - protein, 368 aa, Unknown
  Obtained from environmental sample
  SIGNAL (1)...(22)
  DOMAIN (2)...(346): Glycosyl hydrolases family 8
MKGFRWCVLAVLMLAATNLRAACSWPAWEQFKQDYISESGRVIDPSDARKITTSEGQSYALFFALAANDRKAFDLLLAWTRDNLAGGDLTANLPAWLWGQKDKETWTVIDPNSASDADIWIAWSLLEAGRLWKNQDYTRTGKGLLKRIVSEEVVKVPGLGFMLLPGKTGFAEENAWRFNPSYLPPQLANYFTRLGTPWTTLRETNLRLLLETAPKGFSPNWVQYQKNRGWQLSQDKSLVGSYDAIRVYLWVGMMNDKDPQKARLLARFKPMATVTAKQGVPPEKVDVATGKRTDKGPVGFSASLLPFLQNRDAQAVQRQRVADHFPDNNAYYSYVLTLFGQGWDQHRFRFTTQGELIPNWGQECASSQ

SEQ ID NO: 191 - DNA, 984 bp, Unknown
  Obtained from environmental sample
atgaaaaaaattacacgctgctgtacattgatatgcgcagcaatcatgctattaaactgtagcagttcagccaaaaacgaaaacaaagaaacgtccaaaacaatagtcggcaaacatgggaaactatcggtaaacggcacttccctcgttgatgaaaaaggagagaaaattcaactacggggcgttagttacggatggcacaacttttggccccgtttctacaatgcctctacagtaaaagtattcgtagaagattggaaatgcagtgtactccgggcagctataggcgtagaggaacggagaggatatatagacaacacggcagaagccatccgttgtgcgacagttgtcgcagatgcggccatcgaacaaggcatctatgtgatcatcgattggcacagccatggcatacgcacagcagaagccaaacaattcttcacgcaaatggccaatcgctacaaaggccacccgaacgtgatctacgaaatctttaacgaaccggtagaagattcctgggaagatgtaaaagcatattccatcgaaatcatacagaccatccgggcgattgacccggataatataatattagtcggcaccccacactgggatcaagacatacatctggcagccgatagcccgatcagcggattcaacaatctgatgtacacgctacacttctatgcagccacacatcatcaggaacttagagaccgtggaaattatgccattcaaaaaggtcttcctatatttgtatcagagtgtggaggaatggaagcctcaggcgacggcccaatcgaccacgccgaatgggcggcctggttaagttggatggataaaaacaacatcagctgggcagcatggtcaatagccgataaggacgaaacctgctccatgatgaaaaaaacagcttcatcggaagggccatggacagagaatgagctgaaagaatgggggacaatgtgccacaacgaaatctctaaatag

SEQ ID NO: 192 - protein, 327 aa, Unknown
  Obtained from environmental sample
  SIGNAL (1)...(24)
  DOMAIN (47)...(297): Cellulase (glycosyl hydrolase family 5)
  SITE (19)...(22): N-glycosylation site. Prosite id = PS00001
  SITE (45)...(48): N-glycosylation site. Prosite id = PS00001
  SITE (76)...(79): N-glycosylation site. Prosite id = PS00001
  SITE (161)...(170): Glycosyl hydrolases family 5 signature. Prosite id = PS00659
  SITE (285)...(288): N-glycosylation site. Prosite id = PS00001
MKKITRCCTLICAAIMLLNCSSSAKNENKETSKTIVGKHGKLSVNGTSLVDEKGEKIQLRGVSYGWHNFWPRFYNASTVKVFVEDWKCSVLRAAIGVEERRGYIDNTAEAIRCATVVADAAIEQGIYVIIDWHSHGIRTAEAKQFFTQMANRYKGHPNVIYEIFNEPVEDSWEDVKAYSIEIIQTIRAIDPDNIILVGTPHWDQDIHLAADSPISGFNNLMYTLHFYAATHHQELRDRGNYAIQKGLPIFVSECGGMEASGDGPIDHAEWAAWLSWMDKNNISWAAWSIADKDETCSMMKKTASSEGPWTENELKEWGTMCHNEISK

SEQ ID NO: 193 - DNA, 993 bp, Unknown
  Obtained from environmental sample
atgcgaaaacccgcatgcgccaccctggctgtcatgatgagtttgctgttcactcctttctctcaggcaggtcaggcctgggagagttacaaagcgcgcttctttaagccggatgggcgaatcgtcgataccggcaacggtaacgtttcccataccgaaggccagggttttgccatgctgatggcggtggcaaacgatgataaagcgacctttgataaactctggcactggacgagcagtacgctgaagaataaagagaacggtcttttttactggcgttataatcccgctcaggcagacccgattgccgacaaaaacaatgcctccgatggcgatgtgctcattgcctgggctctgttaaaagcgaacgcgcgctggcatgacaaaggctacagcacggcatcggatgccattaccaaagcgctgcttgcccataacgttatccgctatgcgggttaccgcgtgatggtgcccggctcacacgggtttaagcaggacaataacgttgtgcttaatccttcctacttcgtatttcctgcctggcaggcatttgctgagcgcagccatttgcaaatatggcgacagctcgcgcaggacggacagcggctgctgaagaaaatggggacgggtaaagccaatctgccaactgactgggtctctcttgacacgaaagggacgctggcccccgcaaacgcctggccgccccgcatgagttatgacgccatccgcattccgctgtacatcagctggtccaacgcgaaaagccccttgctgaccccgtggcgcgcctggttcgctcagtttccgcgtgaacaaacacccgcatgggttaacgtcacgacgaatgaatacgccccctacatgatggctggcggtctgctggcagtgcgtgatttaacgatgggacagagggtcggcgagcccgacattactgcaaatgatgattactattcggcaagtctgaaaatgctggtgtggatctcagaacaataa

SEQ ID NO: 194 - protein, 330 aa, Unknown
  Obtained from environmental sample
  SIGNAL (1)...(23)
  DOMAIN (1)...(329): Glycosyl hydrolases family 8
  SITE (48)...(51): N-glycosylation site. Prosite id = PS00001
  SITE (108)...(111): N-glycosylation site. Prosite id = PS00001
  SITE (109)...(127): Glycosyl hydrolases family 8 signature. Prosite id = PS00812
  SITE (282)...(285): N-glycosylation site. Prosite id = PS00001
MRKPACATLAVMMSLLFTPFSQAGQAWESYKARFFKPDGRIVDTGNGNVSHTEGQGFAMLMAVANDDKATFDKLWHWTSSTLKNKENGLFYWRYNPAQADPIADKNNASDGDVLIAWALLKANARWHDKGYSTASDAITKALLAHNVIRYAGYRVMVPGSHGFKQDNNVVLNPSYFVFPAWQAFAERSHLQIWRQLAQDGQRLLKKMGTGKANLPTDWVSLDTKGTLAPANAWPPRMSYDAIRIPLYISWSNAKSPLLTPWRAWFAQFPREQTPAWVNVTTNEYAPYMMAGGLLAVRDLTMGQRVGEPDITANDDYYSASLKMLVWISEQ

SEQ ID NO: 195 - DNA, 1545 bp, Unknown
  Obtained from environmental sample
atgaaacgttccatctctgtcttcatcgcctgttttatggtagcggcgcttggcatcagcggtatcattgcaccgaaagcggctgccgcttctaaaacacccgttgctgtaaacggacagcttaccttaaaaggtacgcagctcgtcaatcaaaacggaaaagcggttcagctgaaaggaatcagctcccacggtctacagtggtatggcgattatgtcaacaaagactcgttaaaatggctgagagacgactggggcatcaatgtcttccgcgcggccatgtatacagctgaaggcggctatattgacaatccgtcggttaaaaacaaagtgaaggaagccgtcgaagcggcaaaagaactcggaatctatgtgatcattgactggcacatactgagcgatggcaatccaaaccaaaacaaagcgaaagcaaaagaattttttaacgaaatgtcaagactttatggcaagacgccaaacgtcatttttgaaattgccaacgagccgaacggcgatgtcaactggaatcgcgacattaaaccttacgccgaagaaatcctgtccgtgattcgcaaaaactctccgaaaaatattgtgattgtcggaacaggcacctggagccaggatgtcaatgatgcggcggacaatcagctgaaagacggcaatgtcatgtacgcgctccatttttatgcgggcacgcacggtcagtctttgcgggataaagccgattatgcactcagcaaaggagcgccgattttcgtcacagaatggggaacgagcgatgcttcaggaaacggcggggtctaccttgaccaatccagggagtggctgaaatatttagacagcaaaaaaatcagctgggtaaactggaacttatccgacaaacaagagtcgtcagcagctttaaacccaggcgcctctaaaaacggaggatggtcgcaatccgacttgtccccatcaggcaaattcgtcagggataacatccgcagcgggtcaaacggttcgtcaggagactctggatcgaattcgaaagggtcagatcaaaaagaccaaaaaaaggatcaggataaaccaggtcaagacagcggcgctgcagccaacacgatagcagtacaatacagagcgggggacaacaatgtaaacggcaaccaaatccgccctcagctcaacattaaaaacaacagcaaaaaaaccgtgtctttaaatcgaatcaccgtccgctactggtataaaacgaatcgcaaaggacaaaattttgactgcgactatgcccaaatcggctgcagcaaaatcacgcacaaattcgttcaattaaaaaaagcggtaaacggagcagacacgtatcttgaagtaggatttaaaaatggtacattggcgccgggggctgatactggcgaaatccagatccgtcttcacaatgacggctggagcaattatgcccaaagcggcgactattcattttttaattcaaacacgtttaaaaatacgaaaaaaatcacgttgtatgagaacggaaagctgatttggggcactgaacctaaataa

SEQ ID NO: 196 - protein, 514 aa, Unknown
  Obtained from environmental sample
  SIGNAL (1)...(29)
  DOMAIN (46)...(300): Cellulase (glycosyl hydrolase family 5)
  DOMAIN (371)...(452): Cellulose binding domain
  SITE (163)...(172): Glycosyl hydrolases family 5 signature. Prosite id = PS00659
  SITE (295)...(298): N-glycosylation site. Prosite id = PS00001
  SITE (338)...(341): N-glycosylation site. Prosite id = PS00001
  SITE (399)...(402): N-glycosylation site. Prosite id = PS00001
MKRSISVFIACFMVAALGISGIIAPKAAAASKTPVAVNGQLTLKGTQLVNQNGKAVQLKGISSHGLQWYGDYVNKDSLKWLRDDWGINVFRAAMYTAEGGYIDNPSVKNKVKEAVEAAKELGIYVIIDWHILSDGNPNQNKAKAKEFFNEMSRLYGKTPNVIFEIANEPNGDVNWNRDIKPYAEEILSVIRKNSPKNIVIVGTGTWSQDVNDAADNQLKDGNVMYALHFYAGTHGQSLRDKADYALSKGAPIFVTEWGTSDASGNGGVYLDQSREWLKYLDSKKISWVNWNLSDKQESSAALNPGASKNGGWSQSDLSPSGKFVRDNIRSGSNGSSGDSGSNSKGSDQKDQKKDQDKPGQDSGAAANTIAVQYRAGDNNVNGNQIRPQLNIKNNSKKTVSLNRITVRYWYKTNRKGQNFDCDYAQIGCSKITHKFVQLKKAVNGADTYLEVGFKNGTLAPGADTGEIQIRLHNDGWSNYAQSGDYSFFNSNTFKNTKKITLYENGKLIWGTEPK

SEQ ID NO: 197 - DNA, 972 bp, Unknown
  Obtained from an environmental sample
atggaacagtcagttgctgaaagtgatagcaactcagcatttgaatacaacaaaatggtaggtaaaggagtaaatattggaaatgctttagaagctcctttcgaaggagcttggggagtaagaattgaggatgaatattttgagataataaagaaaaggggatttgattctgttaggattcccataagatggtcagcacatatatccgaaaagccaccatatgatattgacaggaatttcctcgaaagagttaaccatgttgtcgatagggctcttgagaataatttaacagtaatcatcaatacgcaccattttgaagaactctatcaagaaccggataaatacggcgatgttttggtggaaatttggagacagattgcaaaattctttaaagattacccggaaaatctgttctttgaaatctacaacgagcctgctcagaacttgacagctgaaaaatggaacgcactttatccaaaagtgctcaaagttatcagggagagcaatccaacccggattgtcattatcgatgctccaaactgggcacactatagcgcagtgagaagtctaaaattagtcaacgacaaacgcatcattgtttccttccattactacgaacctttcaaattcacacatcagggtgccgaatgggttaatcccatcccacctgttagggttaagtggaatggcgaggaatgggaaattaaccaaatcagaagtcatttcaaatacgtgagtgactgggcaaagcaaaataacgtaccaatctttcttggtgaattcggtgcttattcaaaagcagacatggactcaagggttaagtggaccgaaagtgtgagaaaaatggcggaagaatttggattttcatacgcgtattgggaattttgtgcaggatttggcatatacgatagatggtctcaaaactggatcgaaccattggcaacagctgtggttggcacaggcaaagagtaa

SEQ ID NO: 198 - protein, 323 aa, Unknown
  Obtained from an environmental sample
  DOMAIN (27)...(303): Cellulase (glycosyl hydrolase family 5)
  SITE (96)...(99): N-glycosylation site. Prosite id = PS00001
  SITE (150)...(153): N-glycosylation site. Prosite id = PS00001
MEQSVAESDSNSAFEYNKMVGKGVNIGNALEAPFEGAWGVRIEDEYFEIIKKRGFDSVRIPIRWSAHISEKPPYDIDRNFLERVNHVVDRALENNLTVIINTHHFEELYQEPDKYGDVLVEIWRQIAKFFKDYPENLFFEIYNEPAQNLTAEKWNALYPKVLKVIRESNPTRIVIIDAPNWAHYSAVRSLKLVNDKRIIVSFHYYEPFKFTHQGAEWVNPIPPVRVKWNGEEWEINQIRSHFKYVSDWAKQNNVPIFLGEFGAYSKADMDSRVKWTESVRKMAEEFGFSYAYWEFCAGFGIYDRWSQNWIEPLATAVVGTGKE

SEQ ID NO: 199 - DNA, 978 bp, Unknown
  misc_feature: Aquifex aeolicus DNA
gtgaagttctttactgttcttttgtttttcctttcattcgttttttcggcgagtattgacgtgtggaaattgtgggaacattataaaaagacctttataagtaaagaggggtacgtggtagatccttacaacaattacagggttacttcggaagctcaaggctatacacttctcatatccgccctcataggggataaggaaaccttctacagggtatggaactggacaaaggaaaatctcaaaaggaaggataatttattctcctggctctggataaacggacacgtagttgacagaaacaacgcaacggacgccgacctgttcatagcttacgctctgctaatcgcttctcaaaagtggaaggattatacgctcctgagcgaggcaaagaggataaaggattccgtcaaggaactcgttgtgcccgtgtgcaacggaagaagggattacctttttatacccgcaaaggaaggttacattaaaaacaatatagtgagtttaaacgtagtctactacgtcccattcatcttcagaaagttctacgaatctttcggagaggacgtgtggaaaaacctctataggtacacctacgacatttatacgattaggaatatatcaacgcaccttacatacgacctattcaaaaaggaattgagaaaggggaattttatagacatagacggcatgcgtttcctgatatacgcttacgtggacgacaaaaggagtctcctttacatgaggaacgcagtagagggtattctgaagttttacagagaaaagggttacattcctttgaagtataattacgtaaccggtggagcaagcaagttaaaagctcccttttgtttttactacgtattcagtaagctccttccttccgataaaaacttagaaaaggagttcagaaatgggcttgagtacgacaagaagaattactactgttacgctctgcttcttattgctctcctacacgattag

SEQ ID NO: 200 - protein, 325 aa, Unknown
  DOMAIN (1)...(325): Aquifex aeolicus protein
  SIGNAL (1)...(16)
  DOMAIN (1)...(324): Glycosyl hydrolases family 8
  SITE (75)...(78): N-glycosylation site. Prosite id = PS00001
  SITE (102)...(105): N-glycosylation site. Prosite id = PS00001
  SITE (103)...(121): Glycosyl hydrolases family 8 signature. Prosite id = PS00812
  SITE (207)...(210): N-glycosylation site. Prosite id = PS00001
MKFFTVLLFFLSFVFSASIDVWKLWEHYKKTFISKEGYVVDPYNNYRVTSEAQGYTLLISALIGDKETFYRVWNWTKENLKRKDNLFSWLWINGHVVDRNNATDADLFIAYALLIASQKWKDYTLLSEAKRIKDSVKELVVPVCNGRRDYLFIPAKEGYIKNNIVSLNVVYYVPFIFRKFYESFGEDVWKNLYRYTYDIYTIRNISTHLTYDLFKKELRKGNFIDIDGMRFLIYAYVDDKRSLLYMRNAVEGILKFYREKGYIPLKYNYVTGGASKLKAPFCFYYVFSKLLPSDKNLEKEFRNGLEYDKKNYYCYALLLIALLHD

SEQ ID NO: 201 - DNA, 1311 bp, Unknown
  Obtained from environmental sample
atgtttccacgtctttcaccaagccgcttcaggcaagttaccttaaccttgctcacgctcggccttgtgtcactgaccggttgtgcaggtaacagcaagccggatgcagacaccagtactgctggtgccgttgctaccggcgagtaccgcaatctgtttgccgaaatcggaaaaagcgaaatagacatccagcgcaaaattgacgaggcgtttcagcacttgttttatggcgacgcgaaagatgcagctgtctactatcaagcgggtggaaacgagaatggtccactcgcatatgtttacgatgtgaacagcaatgacgtgcgctcagaaggcatgagctacggcatgatgattactgttcaaatggacaaaaaagccgagttcgatgcaatctggaactgggcgaaaacctatatgtatcaagactcccccacgcatccagcgtttggttactttgcctggtccatgcgccgcgatggtgtcgccaatgacgatatgccagcgccagatggcgaggaatatttcgtgaccgctctctatttcgccgccgcccgctggggtaatggcgaaggtattttcaactaccaacaggaagcggacaccattttgagccgcatgcgccaccgccaggtgatcaccggcccaaccaatcgcggagtaatgactgcgaccaatctgttccacccggaagaggcgcaagtgcgcttcacgcccgacatcaataatgctgatcatacagacgcgtcttaccatctgccctcgttctatgaaatttgggcacgtgtcgcgccgcaagaagatcgcgcgttttgggccaaagcggccgatgtgagccgcgactattttgccaaagccgcccaccctgtcactgcgttaacaccggactacggtaattttgatggcaccccgtgggcggcatcctggcggccggagtcggtagattttcgatacgatgcctggcgttccgtcatgaactggtccatggactatgcctggtggggcaaagattcaggcgcacctgcgcgcagtgataaattactcgcgttcttcgaaacccaggaaggcaaaatgaaccacctctatagcctggatggcaaaccgctgggtggtggaccgaccctcggcctaatttccatgaatgcaacggcagctatggcagctactgatccccgctggcacaattttgtggaaaagctctggcaacaacaaccccccacagggcaataccggtactacgacggtgttctatacctgatggcgctgctacattgcgctggggagtacaaagcgtggatccccgacggggaataa

SEQ ID NO: 202 - protein, 436 aa, Unknown
  Obtained from environmental sample
  SIGNAL (1)...(29)
  DOMAIN (67)...(426): Glycosyl hydrolases family 8
  SITE (385)...(388): N-glycosylation site. Prosite id = PS00001
MFPRLSPSRFRQVTLTLLTLGLVSLTGCAGNSKPDADTSTAGAVATGEYRNLFAEIGKSEIDIQRKIDEAFQHLFYGDAKDAAVYYQAGGNENGPLAYVYDVNSNDVRSEGMSYGMMITVQMDKKAEFDAIWNWAKTYMYQDSPTHPAFGYFAWSMRRDGVANDDMPAPDGEEYFVTALYFAAARWGNGEGIFNYQQEADTILSRMRHRQVITGPTNRGVMTATNLFHPEEAQVRFTPDINNADHTDASYHLPSFYEIWARVAPQEDRAFWAKAADVSRDYFAKAAHPVTALTPDYGNFDGTPWAASWRPESVDFRYDAWRSVMNWSMDYAWWGKDSGAPARSDKLLAFFETQEGKMNHLYSLDGKPLGGGPTLGLISMNATAAMAATDPRWHNFVEKLWQQQPPTGQYRYYDGVLYLMALLHCAGEYKAWIPDGE

SEQ ID NO: 203 - DNA, 990 bp, Unknown
  Obtained from environmental sample
atgtggcagcgaagtaaaaccctggttctggtgctgggactgttgttaagtcatcaggcctttgccggccccgcctgggacagctacaaagcgcgatttttgatggcggatggtcgcatcattgataccggcaacaacagtgtgagccacactgaggggcagggcttcgccatgatgatggcggtgcgtaacaacgatcgcgccggttttgacaaaatctggaactggacgaaaaagaacctgcagaatcccgagaccggactgttctactggcgttataacccggtggcaccggacccgattgccgacagaaacaatgccaccgacggcgatacctttatcgcctgggcgctgttaaaagcgggtacccagtggaatgacaacagctatctgaacgcctcggacgccatcactaaatcgctgctggcccgcaacgtaatcagctttgccggttaccgcgtgatgctgcctggcgcgaagggctttaacctcaacagctacgtgaaccttaatccgtcctatttcatcttccctgcgtgggaggatttcgcgaagcgcagtcatctgacggtgtggcgtgacctgatcaatgacggacagaagctgctggtgaagatgcgcttcggcaatacccagcttcctgcagactgggtttccctgtacgccgacggtcgcgtgaccccggccaaagagtggccggcgcgctttagctacgatgcgatccgcgtcccgctgtatatcaagtgggcgaatgcttccagcccgctgatggccccttacaccgcgtactggggacggtttgcccgtacccagacgccagcctgggtgaatgtcaccaccggcgatccggcgccgtatatgatggcgggtgggttgctggcggtgcgtgatttggcgctggggcaacttccggcgggcgatccgcagatcacgacgcaggaggattactattctgcgagtctgaagatgctggtgtcgttagcgaaataa

SEQ ID NO: 204 - protein, 329 aa, Unknown
  Obtained from environmental sample
  SIGNAL (1)...(22)
  DOMAIN (1)...(329): Glycosyl hydrolases family 8
  SITE (45)...(48): N-glycosylation site. Prosite id = PS00001
  SITE (76)...(79): N-glycosylation site. Prosite id = PS00001
  SITE (107)...(110): N-glycosylation site. Prosite id = PS00001
  SITE (108)...(126): Glycosyl hydrolases family 8 signature. Prosite id = PS00812
  SITE (134)...(137): N-glycosylation site. Prosite id = PS00001
  SITE (254)...(257): N-glycosylation site. Prosite id = PS00001
  SITE (281)...(284): N-glycosylation site. Prosite id = PS00001
MWQRSKTLVLVLGLLLSHQAFAGPAWDSYKARFLMADGRIIDTGNNSVSHTEGQGFAMMMAVRNNDRAGFDKIWNWTKKNLQNPETGLFYWRYNPVAPDPIADRNNATDGDTFIAWALLKAGTQWNDNSYLNASDAITKSLLARNVISFAGYRVMLPGAKGFNLNSYVNLNPSYFIFPAWEDFAKRSHLTVWRDLINDGQKLLVKMRFGNTQLPADWVSLYADGRVTPAKEWPARFSYDAIRVPLYIKWANASSPLMAPYTAYWGRFARTQTPAWVNVTTGDPAPYMMAGGLLAVRDLALGQLPAGDPQITTQEDYYSASLKMLVSLAK

SEQ ID NO: 205 - DNA, 3033 bp, Unknown
  misc_feature: Bacterial DNA
atgggaacatctcttatgatcaaatctacactgacaggtatgattactgctgttgccgccgcagttttcaccacctctgcagctttcgcggatgtacctccgttgacagtgagcggaaatcaggttttaagtggcggtgaagcaaaaagcttcgctggtaacagcttcttttggagcaataccggatggggccaggaacgtttttacaacgcagaaactgtgcgttggttgaaagacgactggaacgcaaccattgtccgcgccgctatgggcgtagactttgatggcagctatatccccgagcatgaagacgccgaccccgagggtaacgtcgctcgcgtacgtgcattggtggatgcagccatcgcagaagacatgtacgtgattatcgattttcacactcaccacgcagaagattaccaagccgaatctatcgagttcttcgaagaaatggccacactgtacggtgggtacgacaatgttatttatgaaatctataacgagcccctgcaaatcagctgggacaatgttattaaaccttatgcagaatcggtgattggcgctatccgcgcaatcgacccggacaacctgattatcgtcggcacgcccacttggtcacaggacgtggacgccgctgcgcgcaatccaatcaccagctacagcaatattgcgtacaccctgcacttttacgcaggcactcacggttcatggttgcgcgataaagcgcgtaacgctatgaacagtggtattgcgctgtttgtgactgagtggggcaccgttaatgcagatggcgatggtgcgcctgcagttaacgaaactcagcaatggatggacttcctcaagcagaacaatatctctcacttgaactggtccgtgagtgataaattggaaggtgcgtctatcgtacaacctggcacgcccattagcggctggaacgcttctgaccttacggcctccggcacactggttaagaacatcgtttccaactggggcaccacaatcggtaacggcagctcctcaagttcatccagctcctcttccagctcttcaagcagttcttcttcgagcagttcctcctccagcagctcttcctcgtcaagcagctccggatcaactggtggcggcaactgtgctggagtgaatgtgtacccgaactggaccgcgcgtgactggtctggcggcgcctacaaccatgcgaacgctggcgaccaaatggtctatcaaaacagcctgtatcgtgccaactggtacaccaacagcgtgcctggcagcgacgcctcctggactagccttggcgcctgcggaggcaacggaagtacgacctcatccagctcaagcagctcctcgtcaagcagcagctcttcttccagcagctcctcgtctactggcggtggctccagctcctccagcagttcatcttcttcatcgtcgtcttccagcagctctagcagcactggtggcggtcaatgtaccgaagtgtgcaactggtacggtcagggaacctacccactgtgtaacaacaccagtggttggggttgggaaaacaatcagagctgtatcggccgtcaaacctgtgagtcacagaacggtggcgctggcggcgtggtgagcaactgcaccggttcgagtacatccagcagctcctcttccagcagtagttcttcctcaagtagcagctccagttcatccagcagctcttcatctggcactggtagcagtacatcttccagcagcagctcttccagcagctccagctcaagtaccggttcctccggtatgcctggaccacgcgtggacaaccccttcgccgctgcgcagaagtggtacataaacccaatgtggtcagcgagtgctgcaaacgaacccggcggctctgtcattgccaacgaaccctcgtttgtatggatggaccgtatcggcgcaatcgaagggcctgctgacggtatgggcctgcgcgaccacttgaacgaagcccttgcacaaggcgccgacctgttcatgtttgttgtgtacgacctgccaaaccgtgactgtgctgcactcgcctccaacggtgaactgcgcatctccgaagatggcttcaacatctacaagtccgactacatcgcacctatcgttgaaatcatcagcgaccctgcatacgcaggtatcaaaatcgctgcggttatcgaggtggactcactgcctaacctggttaccaatctgagcgaacctgactgtcaggaagcaaatggtcctggcggctaccgcgacggcattcgtcacgctatcactgaactgggcaaaatccccaacgtatactcctacgtggatattgcacactcaggctggctgggctggaacgacaacttcgcgcaaggcgttaacctgatttatgaagtggttgccaacctcggttccggcattaacccaatcgccggtttcgtcagtaactccgctaactacacgcctgtggaagaacccttcttgccagacgccaacctgcaggtcggtggtcagcccgttcgctcttccgatttctatgagtggaacagctacctggcagagaaacccttcgtgaccgattggcgttctgccatgatctcgaaaggtatgccaagctccatcggtatgctgatcgataccgcacgtaacggctggggtggccctgagcgtccaactgcgcagtctacctccaacaacctgaacaccttcgttaacgaatcacgtatcgaccgtcgtgagcaccgcggcaactggtgtaaccagcctggtggtgtcggctaccgtccaaccgctgcaccttctccaggtattgatgcctacgtttgggtgaaaccacagggtgagtctgacggtgtttccgatcctaacttcgagatcgatcctaacgacccgaacaaacagcacgacccaatgtgtgatccgttcgccagcaactcgtccaacagtgcatacggcaccggcgctatgccaaatgctccgcacgctggtcgctggttccctgaagccttccagttactgcttgaaaacgcttacccaccaattaactag

SEQ ID NO: 206 - protein, 1010 aa, Unknown
  DOMAIN (1)...(1010): Bacterial protein
  SIGNAL (1)...(30)
  DOMAIN (39)...(300): Cellulase (glycosyl hydrolase family 5)
  DOMAIN (393)...(428): Carbohydrate binding domain
  DOMAIN (493)...(521): Cellulose or protein binding domain
  DOMAIN (610)...(959): Glycosyl hydrolases family 6
  SITE (83)...(86): N-glycosylation site. Prosite id = PS00001
  SITE (163)...(172): Glycosyl hydrolases family 5 signature. Prosite id = PS00659
  SITE (275)...(278): N-glycosylation site. Prosite id = PS00001
  SITE (288)...(291): N-glycosylation site. Prosite id = PS00001
  SITE (293)...(296): N-glycosylation site. Prosite id = PS00001
  SITE (316)...(319): N-glycosylation site. Prosite id = PS00001
  SITE (341)...(344): N-glycosylation site. Prosite id = PS00001
  SITE (390)...(393): N-glycosylation site. Prosite id = PS00001
  SITE (443)...(446): N-glycosylation site. Prosite id = PS00001
  SITE (513)...(516): N-glycosylation site. Prosite id = PS00001
  SITE (523)...(526): N-glycosylation site. Prosite id = PS00001
  SITE (546)...(549): N-glycosylation site. Prosite id = PS00001
  SITE (679)...(695): Glycosyl hydrolases family 6 signature 1. Prosite id = PS00655
  SITE (745)...(748): N-glycosylation site. Prosite id = PS00001
  SITE (913)...(916): N-glycosylation site. Prosite id = PS00001
  SITE (987)...(990): N-glycosylation site. Prosite id = PS00001
MGTSLMIKSTLTGMITAVAAAVFTTSAAFADVPPLTVSGNQVLSGGEAKSFAGNSFFWSNTGWGQERFYNAETVRWLKDDWNATIVRAAMGVDFDGSYIPEHEDADPEGNVARVRALVDAAIAEDMYVIIDFHTHHAEDYQAESIEFFEEMATLYGGYDNVIYEIYNEPLQISWDNVIKPYAESVIGAIRAIDPDNLIIVGTPTWSQDVDAAARNPITSYSNIAYTLHFYAGTHGSWLRDKARNAMNSGIALFVTEWGTVNADGDGAPAVNETQQWMDFLKQNNISHLNWSVSDKLEGASIVQPGTPISGWNASDLTASGTLVKNIVSNWGTTIGNGSSSSSSSSSSSSSSSSSSSSSSSSSSSSSSSSGSTGGGNCAGVNVYPNWTARDWSGGAYNHANAGDQMVYQNSLYRANWYTNSVPGSDASWTSLGACGGNGSTTSSSSSSSSSSSSSSSSSSSSTGGGSSSSSSSSSSSSSSSSSSSTGGGQCTEVCNWYGQGTYPLCNNTSGWGWENNQSCIGRQTCESQNGGAGGVVSNCTGSSTSSSSSSSSSSSSSSSSSSSSSSSSGTGSSTSSSSSSSSSSSSSTGSSGMPGPRVDNPFAAAQKWYINPMWSASAANEPGGSVIANEPSFVWMDRIGAIEGPADGMGLRDHLNEALAQGADLFMFVVYDLPNRDCAALASNGELRISEDGFNIYKSDYIAPIVEIISDPAYAGIKIAAVIEVDSLPNLVTNLSEPDCQEANGPGGYRDGIRHAITELGKIPNVYSYVDIAHSGWLGWNDNFAQGVNLIYEVVANLGSGINPIAGFVSNSANYTPVEEPFLPDANLQVGGQPVRSSDFYEWNSYLAEKPFVTDWRSAMISKGMPSSIGMLIDTARNGWGGPERPTAQSTSNNLNTFVNESRIDRREHRGNWCNQPGGVGYRPTAAPSPGIDAYVWVKPQGESDGVSDPNFEIDPNDPNKQHDPMCDPFASNSSNSAYGTGAMPNAPHAGRWFPEAFQLLLENAYPPIN

SEQ ID NO: 207 - DNA, 984 bp, Unknown
  Obtained from environmental sample
gtgattgacccgagcgacgcgcgcaaaatcaccacctccgaagggcaaagctacgccttgttcttcgcgctggcggcgaacgatcgtgaagccttcgcttcgctgtttgactggacgcaaaacaacctggcggaaggggatttaaaagcccatcttcccgcctggctgtggggtaaaaaggcggacgacagctggaccgtgctcgacggtaactccgcgtcagatgccgatatctggatagcctggtcgctgctcgaagccgggcggctgtggaaaatgccgcagtacagcgaaaccggtaaagccctgctgtctcgcatcgccaaagaggaagtggtgaaagtgcccggtctgggctctatgctgctaccgggtaaagtgggctttgttgatgacgccggctggcgctttaacccaagctatttgcctccgcagattgcggcttacttcgcgcgttttggcgagccgtggagcgcgattcaggccaccaaccttcgcctgctgcaggaaacggcacctaaaggctactcgcctaactgggtacgttttgacaacaaaaaaggctggcagctaaagcaggataaatcgctgctcggcagctacgacgcgatccgcgtgtatctttgggtcggcatgctcaacgacgccgatccgcagaaaccgcggctgctgaaaaagttcaggccaatggcgatgcaaaccgccaaagcgggcgcggtgccggagaaaatcgatattgccaccgggaaggtggagggcgatggcccggtcggtttttctgcctcgctgctgccgtttttacaggaccgggacgctcaggccgttcagcgccagcgcgtcgccgaccgtttccccggcaatgacgcctattacagctatgttttgaccctgttcggacaaggatgggatcagcatcgttttcgcttcaccgctcgcggtgaacttctacctgactggggccaggaatgcgtaagttctcactaa

SEQ ID NO: 208 - protein, 327 aa, Unknown
  Obtained from environmental sample
  DOMAIN (1)...(305): Glycosyl hydrolases family 8
  SITE (74)...(92): Glycosyl hydrolases family 8 signature. Prosite id = PS00812
MIDPSDARKITTSEGQSYALFFALAANDREAFASLFDWTQNNLAEGDLKAHLPAWLWGKKADDSWTVLDGNSASDADIWIAWSLLEAGRLWKMPQYSETGKALLSRIAKEEVVKVPGLGSMLLPGKVGFVDDAGWRFNPSYLPPQIAAYFARFGEPWSAIQATNLRLLQETAPKGYSPNWVRFDNKKGWQLKQDKSLLGSYDAIRVYLWVGMLNDADPQKPRLLKKFRPMAMQTAKAGAVPEKIDIATGKVEGDGPVGFSASLLPFLQDRDAQAVQRQRVADRFPGNDAYYSYVLTLFGQGWDQHRFRFTARGELLPDWGQECVSSH

SEQ ID NO: 209 - DNA, 990 bp, Unknown
  Obtained from environmental sample
atgctggtgcgactgctgatagcgatgaccgtgctgttttctgcctttgcccacgccgatgcgtgggaaagctataaatcccggtttgtcatgcccgacgggcgcgtggtggataccggcaatggcaacgtttcgcataccgaaggccaggggtttgccatgctgatggcggtcagcctgaatgaccgccagacgtttgataagctttggcagtggaccaatgcgacgctaaaaaacaaagataacggcctgttttactggcgctataacccgaccgcggcggaccctatcaccgataaaaacgatgccaccgatggcgatatgatgatcgcctgggccttgctaaaggcgcagaaacagtggcgcgagaacagctacggtatcgcctcggacgagataacccgcgcgctactgaaacacacggtaataagctacgcgggctacagggtgatgctgccgggcgcgcacggcttcaatctcaacacccgcatcaacctgaacccttcctactttattttcccggcctggcaggctttcgccgaccgcacgcatctggtggtgtggcgcgatctgatgcgcgatggcaaaaagctcatcggcaaaatggggtggggtaatgccaatcttccgaccgactgggttgcgctgagcgctgacggcaaaatgaagcccgccgacgagtggaagccgcgtatgagctatgacgccgtgcgcattccgctgtacatccactggcaggacgcgcaaagcccactgttagcgccgtggaaagcgttctggcagcgctatcagcgtgaacaaacgcctgcgtgggtcaacgtgatgaccaacgaaacctctccttacccgatgaacggtggcctgctggcgattcgcgattacaccctgggcatcaacaccggcgagccgcaaattaccgcgcaggacgactactattccgcgagcctgaaaatgctgacgtggctggcggagcagtctgcgggacgctaa

SEQ ID NO: 210 - protein, 329 aa, Unknown
  Obtained from environmental sample
  SIGNAL (1)...(19)
  DOMAIN (1)...(326): Glycosyl hydrolases family 8
  SITE (43)...(46): N-glycosylation site. Prosite id = PS00001
  SITE (75)...(78): N-glycosylation site. Prosite id = PS00001
  SITE (104)...(122): Glycosyl hydrolases family 8 signature. Prosite id = PS00812
  SITE (281)...(284): N-glycosylation site. Prosite id = PS00001
MLVRLLIAMTVLFSAFAHADAWESYKSRFVMPDGRVVDTGNGNVSHTEGQGFAMLMAVSLNDRQTFDKLWQWTNATLKNKDNGLFYWRYNPTAADPITDKNDATDGDMMIAWALLKAQKQWRENSYGIASDEITRALLKHTVISYAGYRVMLPGAHGFNLNTRINLNPSYFIFPAWQAFADRTHLVVWRDLMRDGKKLIGKMGWGNANLPTDWVALSADGKMKPADEWKPRMSYDAVRIPLYIHWQDAQSPLLAPWKAFWQRYQREQTPAWVNVMTNETSPYPMNGGLLAIRDYTLGINTGEPQITAQDDYYSASLKMLTWLAEQSAGR

SEQ ID NO: 211 - DNA, 1293 bp, Unknown
  Obtained from environmental sample
atgttgacacggagagaattgattgcagcgactgccctggggctcgccgctagtacgaaacttgttgctgctgccacgagtaaaaccagggatgatttcctttggggggtggccacggcgccacaccaaatcgagggcaacaacctgaatgccgacctgtggctggccgaacaggtgaagccgacgatctttcacgagccttcgggcgatgcctgtgacagctaccatcgctatgaggaggatatcgagctggtggcggcgctcggcttcaattgttaccgcttcggcatcgaatgggcccgcatcgagcccgttcccggccagttttcgatcgccgagttggaccactaccggcgcatgctggaggcttgccacgcgcacgggctgacgccggtggtcacgtacaaccatttcaccgcgccgcgctggtttgcagccaagggcggtttcacccagccggaggctgccggcctgttcgcccgctatgccggcaaggccacggagcacctaggtgacctgatcggcatggcgctgacgttcaacgaggccaatatccggcgcattgtcagcttgctcctgggcagtcccgaggcgctccagctgatcgacgcgatgtttgccgagtgcgcgcgcctcagcggatccgaccggttctggtcgatggtcttttcgccttacggtgaggccgagccaataatggtggacgcccatgccaaggccagcgcggcgatcaaggccggccccggggactttcccgtcgggctcacgctgtcgatgcaggacgtgcaaggcatcggcgagggcaaccaggccgaggctttgatccaggcactttacggcccatggctcgaggtagcggccgcgtccgatttcgttggcgtgcagacctacacccggatacgcgtgggaccggaaggccgtatcccgcccgacgagggtgccgaacggaccgatacgggcttcgagttctacccggcggcgttgggcggcgcgatccgatttgcgcacgagcgcatcggacgccccatctacgtgaccgagaacggcgtggccgcgaatgacgacagccggcgcattgtctacatagacggcgcattgaaagcgatgaaggactgcatcgacgagggcctggacgtacgtggctacatgcactggtcgctgttggacaacttcgaatggttcgaaggctatgccaagagatacggcctggtggaggttgatcgcgaaaccttcgagcgccgtccgaagccaagcgcccggcacctgggtgcgattgcccgctcgggcctctaa

SEQ ID NO: 212 - protein, 430 aa, Unknown
  Obtained from environmental sample
  SIGNAL (1)...(23)
  DOMAIN (26)...(430): Glycosyl hydrolase family 1
  SITE (348)...(356): Glycosyl hydrolases family 1 active site. Prosite id = PS00572
MLTRRELIAATALGLAASTKLVAAATSKTRDDFLWGVATAPHQIEGNNLNADLWLAEQVKPTIFHEPSGDACDSYHRYEEDIELVAALGFNCYRFGIEWARIEPVPGQFSIAELDHYRRMLEACHAHGLTPVVTYNHFTAPRWFAAKGGFTQPEAAGLFARYAGKATEHLGDLIGMALTFNEANIRRIVSLLLGSPEALQLIDAMFAECARLSGSDRFWSMVFSPYGEAEPIMVDAHAKASAAIKAGPGDFPVGLTLSMQDVQGIGEGNQAEALIQALYGPWLEVAAASDFVGVQTYTRIRVGPEGRIPPDEGAERTDTGFEFYPAALGGAIRFAHERIGRPIYVTENGVAANDDSRRIVYIDGALKAMKDCIDEGLDVRGYMHWSLLDNFEWFEGYAKRYGLVEVDRETFERRPKPSARHLGAIARSGL

SEQ ID NO: 213 - DNA, 1995 bp, Unknown
  Obtained from an environmental sample
atggttcagctctacatcaaaaacggctttccggccggttacgaacacggacccgtcgctacctttaacgttccgatggtagtcaacggcaccctgataaaccagacctttgagctttacgacgttgtcgctgatcccggctggaggttcctgacgtttaaatcaaccaaaaactacgtcaacgcgagcgttgtttttgactacacccacttcatcgagatggccaacgactatctaaacgactcgctgaacagtacttacctcatgtccctggagtttggaaccgagatctacaccaacgggataagttccttcccagggaccgttgatgtagaatggagcttaaacgactattactacgccctggcacccaggggactcacggcggaggatgctttgggaatgtgggcagctcttattcccaacaccggaaacacctccaacggaggaacggaagaaagtggtgaagataacaccggtggcaccaatggaacaaccagcaccaccgaaagcgaaaccgttgtgctaacctatccggatgacggccagtggccgacggcttacattgacgggaacaagaacggcgtccccgattacgttatggagatcaacccctggaacattcagagtgccgatggaaaagcggtgatgcggtacaactactcgaccggttacctgcactactcacaggatctcagtaacatagtaataagaaacgccggcggctgggttcatggatatccagagatctggtacgggaacaagccatggaacgagtacaacgccaccgatggagaggtgcctttgccaggacaagttgggaagctcaacaacttctacgtaactgtaaactacaacctcacccacgaaaacggtctgcctgttgaccttgcgatagagtcgtggctgacgagggataagtggcgctcaaccgggataaagagcgatgagcaggagctcatgatatggctctactacgatggcctccagccagccggttcaaaggtgggggagataacggttcccataatagttaacggagttgagaaaaacgcaaccttcgaagtttggaaaggcaacattggatgggagtacgtggccttcaggataaaaacgccgcttccttcggccaacgtaacccttccctacggtcccttcatcagtgccgccatgaacgtgacatcgctgaaggattacgcctcgctttaccttgaggacgtggaggttggaaccgagttcggaagtccaagcgtcacatctgcaaaacttgagtggactttctatgagttcaaactaacctacacagacgggccattgataaccaacgtttcggtatctgcaggtggctccaactcgggcaattccaacggtattaatggaaaccagtctgccacctccggaaacctgacggtaagccttaagaacgcctggggaggtggcgctcagtacagcgttaacataaccctcgatggaaaggctgtgtggagggttctcctcaggataaaggacggcagtgttgttgattcatggggtggaaaggtcactggaatgaacggaagctacgttgttattgaggccgaggactacaacctggggccaaaggcggttttgggctttgttacgtccggagctgcaccaatagtgcaggaagccctcctgcttgtcaacggggaagtcgtggcaaggtgggaggcacctgttgagaggcctgcgctggaagtggatggatacgttgacagtgaatggaacgacgggttcgtgtacaaaataaggataaccaacaggggaagcgctccagttgcagggtggactttgacactctcaatgacgagcgagatagtgagcatctggggagcgacctacgagagacttcctgacggaacgatagtccttaaaccgatggactacacctcggtaatagctccgggacagagcgttgagataggctttcaggctaagaaggcaggagatataccatatccaaggatagtttaa

SEQ ID NO: 214 - protein, 664 aa, Unknown
  Obtained from an environmental sample
  DOMAIN (265)...(435): Glycosyl hydrolase family 12
  DOMAIN (572)...(662): Cellulose binding domain
  SITE (29)...(32): N-glycosylation site. Prosite id = PS00001
  SITE (34)...(37): N-glycosylation site. Prosite id = PS00001
  SITE (61)...(64): N-glycosylation site. Prosite id = PS00001
  SITE (81)...(84): N-glycosylation site. Prosite id = PS00001
  SITE (85)...(88): N-glycosylation site. Prosite id = PS00001
  SITE (147)...(150): N-glycosylation site. Prosite id = PS00001
  SITE (165)...(168): N-glycosylation site. Prosite id = PS00001
  SITE (223)...(226): N-glycosylation site. Prosite id = PS00001
  SITE (265)...(268): N-glycosylation site. Prosite id = PS00001
  SITE (290)...(293): N-glycosylation site. Prosite id = PS00001
  SITE (356)...(359): N-glycosylation site. Prosite id = PS00001
  SITE (383)...(386): N-glycosylation site. Prosite id = PS00001
  SITE (398)...(401): N-glycosylation site. Prosite id = PS00001
  SITE (448)...(451): N-glycosylation site. Prosite id = PS00001
  SITE (468)...(471): N-glycosylation site. Prosite id = PS00001
  SITE (475)...(478): N-glycosylation site. Prosite id = PS00001
  SITE (493)...(496): N-glycosylation site. Prosite id = PS00001
  SITE (525)...(528): N-glycosylation site. Prosite id = PS00001
MVQLYIKNGFPAGYEHGPVATFNVPMVVNGTLINQTFELYDVVADPGWRFLTFKSTKNYVNASVVFDYTHFIEMANDYLNDSLNSTYLMSLEFGTEIYTNGISSFPGTVDVEWSLNDYYYALAPRGLTAEDALGMWAALIPNTGNTSNGGTEESGEDNTGGTNGTTSTTESETVVLTYPDDGQWPTAYIDGNKNGVPDYVMEINPWNIQSADGKAVMRYNYSTGYLHYSQDLSNIVIRNAGGWVHGYPEIWYGNKPWNEYNATDGEVPLPGQVGKLNNFYVTVNYNLTHENGLPVDLAIESWLTRDKWRSTGIKSDEQELMIWLYYDGLQPAGSKVGEITVPIIVNGVEKNATFEVWKGNIGWEYVAFRIKTPLPSANVTLPYGPFISAAMNVTSLKDYASLYLEDVEVGTEFGSPSVTSAKLEWTFYEFKLTYTDGPLITNVSVSAGGSNSGNSNGINGNQSATSGNLTVSLKNAWGGGAQYSVNITLDGKAVWRVLLRIKDGSVVDSWGGKVTGMNGSYVVIEAEDYNLGPKAVLGFVTSGAAPIVQEALLLVNGEVVARWEAPVERPALEVDGYVDSEWNDGFVYKIRITNRGSAPVAGWTLTLSMTSEIVSIWGATYERLPDGTIVLKPMDYTSVIAPGQSVEIGFQAKKAGDIPYPRIV

SEQ ID NO: 215 - DNA, 1716 bp, Unknown
  Obtained from environmental sample
ttgaacgagaccacgacattctacatatacgcctggaaccagaacggctcagttaacaagacggtaactgtaactgtggtagagcagggacagcagccgggtgcttcaggcacaggggagatagtcatatcatatcctgagtcacagtggcctaccgccgagatcgatattgatgacgaccgtgtaaacgactatgttatagagataaacccgtggaacattgagagcgcaaccggctcggcagtcatgacatactacctggataacggtacactatactactcacagtcgctagacaacatagtactaaggaatccaggagcctgggtccacggctacccagagatattctacggcaacaagccgtggaatacttacagcgctacaggcggccaagtaccattgccaggcatggtgtcagagctaaacagcttctacgtgacggttagctataagctaaacccggagccggggcttccagtgaatcttgcaatagaatcatggctgacgagagagcagtggaggactaccgggatcaacccagacgaacaagaactaatgatatggctctactatgacggcctccagcccgcaggctctaagataggcgagatagtggtgcccatatacgtgaacggcacccaggtcaacgccacattcgaggtttggaggggcttcataggctgggagtacatagccttcaggataaaaacccccatgaaatccgctacagtgacaataccctattcgccattcataagcgcggcggcgaatataaccgatcttacagactacgcgagcctatacctagaggacgtcgaggtaggaacagagtatggaagcccatccactagctcagcacatatggaatggtggatctacagcttcaatctaacctacacagaccagcccctactaacagctccaccgccaccacccggtccgggagacggttcaggaggcggtagcgggggcgaagaaggcggtagtggaggagtagcgtcaaatggcaccctgcaagtaagcctagccagctcctggggtagcggcgcccagtatgatatagtagtcttgctagaccaacagtctgagtggagcctgctagtcaaggttgccaacggctatataagcgattcctggggcgctacgctcaacggtactacacaggacggctacatagtactagtctcagaaccctggaacctagggcccacagcaacagcaggcttcataacctcagggtcaaacccgctagtggaagaagttatcctcatagcaggcggccaagagctagacaggtggacggccccccagccagatgcaggagcactcgacgttagactagtaatagaaagcgactgggataccggcttcgtagccaagatctacgtggcaaacaacggggacacgccaatatcgggatggtacatcgaagtacagatgacaagcaccataagcagtatatggggcgcaaaagcccagcctgcaggagacgatacctacattctcacaccagtagactatactgcagtaatatctccaggtcagacaatagaagtaggattcgtagcagaaaaagcaggcaatcacccataccccacaatagtagactacgggatcacaggctccgctagcacacagacgggagcaggaatcgcgattctactagcaacagtagccatcgtgacactaaaccataaaagaagaccagtttaa

SEQ ID NO: 216 - protein, 571 aa, Unknown
  Obtained from environmental sample
  DOMAIN (131)...(301): Glycosyl hydrolase family 12
  DOMAIN (444)...(534): Cellulose binding domain
  SITE (2)...(5): N-glycosylation site. Prosite id = PS00001
  SITE (15)...(18): N-glycosylation site. Prosite id = PS00001
  SITE (19)...(22): N-glycosylation site. Prosite id = PS00001
  SITE (90)...(93): N-glycosylation site. Prosite id = PS00001
  SITE (215)...(218): N-glycosylation site. Prosite id = PS00001
  SITE (220)...(223): N-glycosylation site. Prosite id = PS00001
  SITE (261)...(264): N-glycosylation site. Prosite id = PS00001
  SITE (301)...(304): N-glycosylation site. Prosite id = PS00001
  SITE (341)...(344): N-glycosylation site. Prosite id = PS00001
  SITE (390)...(393): N-glycosylation site. Prosite id = PS00001
MNETTTFYIYAWNQNGSVNKTVTVTVVEQGQQPGASGTGEIVISYPESQWPTAEIDIDDDRVNDYVIEINPWNIESATGSAVMTYYLDNGTLYYSQSLDNIVLRNPGAWVHGYPEIFYGNKPWNTYSATGGQVPLPGMVSELNSFYVTVSYKLNPEPGLPVNLAIESWLTREQWRTTGINPDEQELMIWLYYDGLQPAGSKIGEIVVPIYVNGTQVNATFEVWRGFIGWEYIAFRIKTPMKSATVTIPYSPFISAAANITDLTDYASLYLEDVEVGTEYGSPSTSSAHMEWWIYSFNLTYTDQPLLTAPPPPPGPGDGSGGGSGGEEGGSGGVASNGTLQVSLASSWGSGAQYDIVVLLDQQSEWSLLVKVANGYISDSWGATLNGTTQDGYIVLVSEPWNLGPTATAGFITSGSNPLVEEVILIAGGQELDRWTAPQPDAGALDVRLVIESDWDTGFVAKIYVANNGDTPISGWYIEVQMTSTISSIWGAKAQPAGDDTYILTPVDYTAVISPGQTIEVGFVAEKAGNHPYPTIVDYGITGSASTQTGAGIAILLATVAIVTLNHKRRPV

SEQ ID NO: 217 - DNA, 1065 bp, Unknown
  Obtained from environmental sample
atgcggttcagaaagaatttcgcagttctcatgttaatcgttttgatttcaacgctgtttctatcaactcagtgtaaaggtaacataaagaacgtagaaagcaaaaaggaaggggagacagttcacgtgtcaaagtctgcgtttgattacaacaaaatgattgggagaggcataaatatggggaacgcgcttgaagccccatttgagggagcttggggtgtaacaattgaagatgagtacttcaaattaataaaagaacgcggttttgattctgtgagaatacctgtcaggtggtcagcacatgtttcagaagagccaccttacaaaatcaacgaagattttctaaatagagtgaagcacgttgtcgatgaagcactgaagaataacttaacggtaattattaacactcatcacttcgaagagctgtatgctgatccggacaagaacggtcctatattgattgaaatatggcgtcaggtcgcagagtttttcaaagattatcctgataatctgtttttcgagatttacaacgaacctgctcaaaatttgacagcggaaaaatggaacgaactctacccaaaggttctcgaagtaattagaaagacaaatcctacaaggatagtaataatcgacgttccaaactgggctcattacagcgctataagatcactaaaacttgttgatgacaagaatataatcgtgtcgttccattattatgaacccttcaacttcacccatcaaggtgccgaatgggttacgccaaggctcccagttggcgttgaatggaaaggtgaagaatgggaagtgaataccataagaaaccatttcaaatatgtaagcgactgggcaaagaagaacaatgttccagtttttcttggagaattcggtgcttattcaaaagcagacatgaactcaagagtgagatggactgaaactgtgagaaaaatagctgaagaattcggattttcttatgcatattgggaattctgcgcagggtttggtatctatgatcgctggtcgcagaaatggatcgaaccgctcgcaacttctgttgttgggaggtaa

SEQ ID NO: 218 - protein, 354 aa, Unknown
  Obtained from environmental sample
  DOMAIN (61)...(337): Cellulase (glycosyl hydrolase family 5)
  SITE (184)...(187): N-glycosylation site. Prosite id = PS00001
  SITE (246)...(249): N-glycosylation site. Prosite id = PS00001
MRFRKNFAVLMLIVLISTLFLSTQCKGNIKNVESKKEGETVHVSKSAFDYNKMIGRGINMGNALEAPFEGAWGVTIEDEYFKLIKERGFDSVRIPVRWSAHVSEEPPYKINEDFLNRVKHVVDEALKNNLTVIINTHHFEELYADPDKNGPILIEIWRQVAEFFKDYPDNLFFEIYNEPAQNLTAEKWNELYPKVLEVIRKTNPTRIVIIDVPNWAHYSAIRSLKLVDDKNIIVSFHYYEPFNFTHQGAEWVTPRLPVGVEWKGEEWEVNTIRNHFKYVSDWAKKNNVPVFLGEFGAYSKADMNSRVRWTETVRKIAEEFGFSYAYWEFCAGFGIYDRWSQKWIEPLATSVVGR

SEQ ID NO: 219 - DNA, 1104 bp, Unknown
  Obtained from environmental sample
atggacgaattggaatcatcctgcgcttttcctatgtcccgctacttgctcctatgggtctgggtcatgctttcgagctcggcattcgcccaaccgcaaaaagttgatgacgtagtgatcgacaccacgcacgcaccagcctccccgcctcgcacgtattcacttcctttcgtgcgtgttgaaggcaaccgttttgtcgacgaaaacggccgcacgctcgttttccgaggcgtatcgattgccgatcctgaccgactggagcgcattggcaaatggaataaaacgctttttgaagtgatcaaaaaagactggaatgccaacattgtccgcattccggtccacccccaagcttggcgcgagcgtggcgcgtcggcgtacctaaaacttctcgaccaagcggttgcgtgggctaatgcgctgcagctttacttgatcattgactggcatagcattggtaacttgcgcacagagctctttcagcacccgatgtataacaccaccaaaacggagactttccgtttctggaaaaccattgcagagcactttcgccataatccgatcgtggctttctatgagctttttaacgaacccacccattttaacggtacgctaggtcgcatgtcttgggaagagtacaaggccattatagaagaaatcatctacatcatctacgcgcacgaccagaccgtcatccccctggtagggggctttgattgggcctacgacctcactccggttcgtgagcatcccattaactttcccggggttgcctacacggcgcatccctatcctcaaaaacgccagcccccttgggaagaaaaatgggagcaagactggggatttgtggcaaacacgtatccggtgtttgttaccgaactggggttcatgagcgcagacggccctggtgcccacgttccagtaattggcgatgagacgtatggtgaagcaatccttcgctacatggaacaaaaggggatttcttggacggcatgggtatttgatcccgtttggtccccgcaactcatcgccaattgggattttgaacctacacctcagggccgatttttccgtgacaaaatgcgccagcttaacccacgaaactaa

SEQ ID NO: 220 - protein, 367 aa, Unknown
  Obtained from environmental sample
  SIGNAL (1)...(30)
  DOMAIN (63)...(341): Cellulase (glycosyl hydrolase family 5)
  SITE (94)...(97): N-glycosylation site. Prosite id = PS00001
  SITE (167)...(170): N-glycosylation site. Prosite id = PS00001
  SITE (204)...(207): N-glycosylation site. Prosite id = PS00001
MDELESSCAFPMSRYLLLWVWVMLSSSAFAQPQKVDDVVIDTTHAPASPPRTYSLPFVRVEGNRFVDENGRTLVFRGVSIADPDRLERIGKWNKTLFEVIKKDWNANIVRIPVHPQAWRERGASAYLKLLDQAVAWANALQLYLIIDWHSIGNLRTELFQHPMYNTTKTETFRFWKTIAEHFRHNPIVAFYELFNEPTHFNGTLGRMSWEEYKAIIEEIIYIIYAHDQTVIPLVGGFDWAYDLTPVREHPINFPGVAYTAHPYPQKRQPPWEEKWEQDWGFVANTYPVFVTELGFMSADGPGAHVPVIGDETYGEAILRYMEQKGISWTAWVFDPVWSPQLIANWDFEPTPQGRFFRDKMRQLNPRN

SEQ ID NO: 221 - DNA, 1587 bp, Unknown
  Obtained from environmental sample
atgtctagcgtcgcttcgttgttgtccttgaccttgctgcaggcgcaagcggttaccgtcggcgtggatctcgcgaaagatctgcgcccgatctctccatacgtctacggcacgaacacgtccgactggagcggccgtacgaaatacctgacgatgtggcgctggggcggtaaccggacgaccgcctacaactgggaaaacaacgcgagccacgccggacgcgattgggcacaccagaacgactcgttccttggtggcggggacattcccggcgaggcgcttcgcgcacctctgaccgcggcggtggccgccggcgcggcggcgctcgtgaccgtcccctgcatcggctacgtggccgcggataagaacggcggcggggacgtcaatcagacgccgaactacctcgacgttcggttccatccgtcgtacgccacgaaaggctccgcgttcagcaaccctcccaacgtgaacgaccacgccgtctatcaggacgagttcgtggcttggctgctgaaccgggtcgtcacggatcggccgatctggtttgcgctggacaacgagcccgacctctgggcggagacccacccgcgcattcagacccagaagccgacgtacgcggggatcatggagatatcgaagcgctacgcgcaggcgatcaaatccgtcgcgcccgattccctcgtattcggccccgcgagctacggctggagcggttacgactcgttccaagccgcgtccgacgcgaacggccggttcttcctcgacttctacctgcagaacttccgcacgctgcaggagcagaccggaaagcgctacctcgacgtcctcgacctccactggtatcccgaggcgcgcggcgcgggcaagcgcatcacggaagacggaacggagcagggcctctacaccgcacggatgcaggccccccggtcgctctgggacccaacctacaccgaagactcttggatcgcccagtggggcacccagggaccgattcggctggtaccgcgcatgctggagaagatcgcgggcaactatccgggcaccaagctcgcattcaccgagtggaattacggcggcggcggccacatcaccgggggcatcgcggcggcggacgtcctcggcattttcggccgtgaaggcgtgttcgccgcgaactactgggacatcaaggacgacgagtcgttcgcctacggcggtttcgccatgttccggaacttcgacggtcaaggcgcgcggttcggggacatttccgttcgcgccgccagcggcgacgtagccaaggtgaccgcctacgccagccgggactcgctgtacaaaaacgaagtcaccgtcgtgctgatcaacaagcagtttacgagcacccccgtcaacctcacgctggccggcgcggacggattccagccggtcatcgccgctcggctctcgagcgcgtcgccccgcccgagcccgatcgctctcccggccgtctcaggttcgaccgtgaacctgaccttgccggcgctcacggtcacgaccttgcgcttcaatcgctttacgggtcctcgaccggggggccccatcatgctcccgaagccgaaggggcggtag

SEQ ID NO: 222 - protein, 528 aa, Unknown
  Obtained from environmental sample
  SIGNAL (1)...(17)
  SITE (39)...(42): N-glycosylation site. Prosite id = PS00001
  SITE (58)...(61): N-glycosylation site. Prosite id = PS00001
  SITE (69)...(72): N-glycosylation site. Prosite id = PS00001
  SITE (81)...(84): N-glycosylation site. Prosite id = PS00001
  SITE (464)...(467): N-glycosylation site. Prosite id = PS00001
  SITE (502)...(505): N-glycosylation site. Prosite id = PS00001
MSSVASLLSLTLLQAQAVTVGVDLAKDLRPISPYVYGTNTSDWSGRTKYLTMWRWGGNRTTAYNWENNASHAGRDWAHQNDSFLGGGDIPGEALRAPLTAAVAAGAAALVTVPCIGYVAADKNGGGDVNQTPNYLDVRFHPSYATKGSAFSNPPNVNDHAVYQDEFVAWLLNRVVTDRPIWFALDNEPDLWAETHPRIQTQKPTYAGIMEISKRYAQAIKSVAPDSLVFGPASYGWSGYDSFQAASDANGRFFLDFYLQNFRTLQEQTGKRYLDVLDLHWYPEARGAGKRITEDGTEQGLYTARMQAPRSLWDPTYTEDSWIAQWGTQGPIRLVPRMLEKIAGNYPGTKLAFTEWNYGGGGHITGGIAAADVLGIFGREGVFAANYWDIKDDESFAYGGFAMFRNFDGQGARFGDISVRAASGDVAKVTAYASRDSLYKNEVTVVLINKQFTSTPVNLTLAGADGFQPVIAARLSSASPRPSPIALPAVSGSTVNLTLPALTVTTLRFNRFTGPRPGGPIMLPKPKGR

SEQ ID NO: 223 - DNA, 966 bp, Unknown
  Obtained from environmental sample
atgatgcgcacgctcgtcacgtcggcattcgcgtgcctgctcctgcccctcggcaccgggcaggccgatgccggcgtcctggccgatccgatcggcatgaccagcgggttctacacggacccgaactcgaatccggccgcatgggtcgcggcgaaccccggcgacggacgggcgccggcgatccgggacaacatcgcctcgcgccccatggcccggtggttcggttcctggagcggtgacatcggggccgcggtgggctcctacgtgggagccgcggacgccgccgacaagcttcccgtcctgatcgcctacaacatccccggccgggacgcctgtggcggccactccggcggcggggcgggttctccggcggcgtaccgcacctggatctccgccttcgcctcggccatcggcgggcgaccggcgctggtggtgatcgagcccgactccctcggtgattacagctgtctgacccagcagcagatcgatgagcgcaacgccatgctcaaagacgccctggcgcagttctccgcgcacgcgcccaacacgtggacgtacctggatgcgggaaaccccgcctggatcgacgcggccaccatggcccggcatctcgacggcgccggggcccggcaggcgcacggcttctcgtcgaacatctcgaactactacggcaacagccggaacatcagttacggcaacgccatcaactcggcgctgtcggcctcctacggttacacgaagcctttcgtcatcgacaccagccgcaacggcaacgattccaacggcgagtggtgcaaccccgcagggcggaggatcggggccgtcagccagacgggcggtggagccgagatgctgctgtggctgaagacccccggcgagtccgacggcaactgcggagtcggcgccggctccgtggccggtcagttcctcccggaagtcgcgtacaagatgatctacggatactga

SEQ ID NO: 224 - protein, 321 aa, Unknown
  Obtained from environmental sample
  SIGNAL (1)...(24)
  DOMAIN (39)...(311): Glycosyl hydrolases family 6
  SITE (145)...(154): Glycosyl hydrolases family 6 signature 2. Prosite id = PS00656
  SITE (221)...(224): N-glycosylation site. Prosite id = PS00001
  SITE (231)...(234): N-glycosylation site. Prosite id = PS00001
  SITE (261)...(264): N-glycosylation site. Prosite id = PS00001
MMRTLVTSAFACLLLPLGTGQADAGVLADPIGMTSGFYTDPNSNPAAWVAANPGDGRAPAIRDNIASRPMARWFGSWSGDIGAAVGSYVGAADAADKLPVLIAYNIPGRDACGGHSGGGAGSPAAYRTWISAFASAIGGRPALVVIEPDSLGDYSCLTQQQIDERNAMLKDALAQFSAHAPNTWTYLDAGNPAWIDAATMARHLDGAGARQAHGFSSNISNYYGNSRNISYGNAINSALSASYGYTKPFVIDTSRNGNDSNGEWCNPAGRRIGAVSQTGGGAEMLLWLKTPGESDGNCGVGAGSVAGQFLPEVAYKMIYGY

SEQ ID NO: 225 - DNA, 2007 bp, Unknown
  Obtained from environmental sample
atgaattgcaccatgaaaccgatgacccgcgcggtcgccggcggccttgccgcgcttgcccttgccgcctgcggcagcagtgacagcgacagccccggatacacccagccggtgttcggcaacacgacctacaatatagtcaaggttgatggctataccttcaaggacatgaaccgcaacggcaagatcgacccttacgaggattggcgcctgaccgccgaggcgcgcgccgacgacctgatcggtcgcatgtcgctcgatgaaaaagccggcctgatgatgcatggcacggcgcccacggtggccgacccgaccggcattggccagggcagcggctatgacctgacggccttgcaggagctgatcgtcaagcagtacgtcaacaccttcatcacccgcatggcgggcgattcggccaatatggcggcgcagtacaacaaggtgcaggcgctgagcgaaacctcgcgccacggcattccggtgtcgatctccaccgacccgcgccatcatttccagtacacggtgggcgccagcgcgtcgaccaacggcttttcgcagtggcctgaaaccctgggcctggcagcgattggcgacgatgcgctggtgcgccgcttcggcgacatcgcgcgccaggaatacctggccgtcggcatcacgcaggcgctgtcgccgcaggccgacctggccaccgagccgcgctggtcgcgcatcaacggcacgtttggcgaagacgccgacctggccaagcgcatggtgcagaactatatcgagggcttccaggatggcaataccggcctgcacgacggcagcgtggtggccgttgtcaagcactgggtcggctatggcgcgaccaaagagggttttgacggccacaattactatggccgctacatgacctacccgggcaacaacttcgcctatcacgtgaaaccgttcgaaggcgcgttcaacgccaaggccgcctccgtgatgccgacctacgccctaccggacggcaatatcaccatcgacggcatcacgctggaacaggtggcggccggcttcagcaagaccatgctgaccgatctgctgcgcggcaaatacggcttcgaaggcgtgatcctgtccgactggggcatcacctccgactgcgacgccaactgccgcaacggcacgcccgccggcgtggcgccctcgtttatcggtttcggcacgccgtggggcatggaaaacgccaccaaggccgagcgctacgtgaaagccgtcaatgccggcatggaccagtttggcggcgtgacggaagcgccttacctgacgcaggcggtgcagcgcggccagctgacggaagcgcgcatcaacgcctcggcacgccgcatcctggtacagaaattcaagcagggcctgttcgagcatccgttcgtcgacacggcaaaagccgccgccacggtgggcaaggccgacttcgtcgaagcgggcctggaagcccagcgccgttcgctggtgctgctggaaaacaaggacaaggtgctgccgctggccaccaccgtcaagaaggtgtatttgtacggcatcgacgcggccgtcgcccgccagtacggctacaccgtggtggcgacgccgcaggaagccgacgtggcgctgctgcgcgtggccgcgccgtatgaaatcctgcacccgaactacatcttcggcagcatgcagcacgaaggccgcctcaatttcgtcgacggcgacgccgactacgaggcgatcaagaatgccgcccgcctggcgccgaaaaccgtggtcaccgtctacctggaccgcccggccatcctcggcaacgtgcaggacaaggccagcgccattatcggcaacttcggcgtcagcgacggcgcgctgttcgacgtcttgaccggcaaggccaagccgcaaggcaagctgccattcgagctgccgtcgtcgatggctgaagtgcaggtgcagaagtccgacgtgccatatgacacggcgcggccgctgtacaagttcggctacggtctggcgtac

SEQ ID NO: 226 - protein, 669 aa, Unknown
  Obtained from environmental sample
  SIGNAL (1)...(29)
  DOMAIN (151)...(382): Glycosyl hydrolase family 3 N terminal domain
  DOMAIN (493)...(669): Glycosyl hydrolase family 3 C terminal domain
  SITE (2)...(5): N-glycosylation site. Prosite id = PS00001
  SITE (41)...(44): N-glycosylation site. Prosite id = PS00001
  SITE (241)...(244): N-glycosylation site. Prosite id = PS00001
  SITE (338)...(341): N-glycosylation site. Prosite id = PS00001
  SITE (361)...(378): Glycosyl hydrolases family 3 active site. Prosite id = PS00775
  SITE (410)...(413): N-glycosylation site. Prosite id = PS00001
  SITE (452)...(455): N-glycosylation site. Prosite id = PS00001
MNCTMKPMTRAVAGGLAALALAACGSSDSDSPGYTQPVFGNTTYNIVKVDGYTFKDMNRNGKIDPYEDWRLTAEARADDLIGRMSLDEKAGLMMHGTAPTVADPTGIGQGSGYDLTALQELIVKQYVNTFITRMAGDSANMAAQYNKVQALSETSRHGIPVSISTDPRHHFQYTVGASASTNGFSQWPETLGLAAIGDDALVRRFGDIARQEYLAVGITQALSPQADLATEPRWSRINGTFGEDADLAKRMVQNYIEGFQDGNTGLHDGSVVAVVKHWVGYGATKEGFDGHNYYGRYMTYPGNNFAYHVKPFEGAFNAKAASVMPTYALPDGNITIDGITLEQVAAGFSKTMLTDLLRGKYGFEGVILSDWGITSDCDANCRNGTPAGVAPSFIGFGTPWGMENATKAERYVKAVNAGMDQFGGVTEAPYLTQAVQRGQLTEARINASARRILVQKFKQGLFEHPFVDTAKAAATVGKADFVEAGLEAQRRSLVLLENKDKVLPLATTVKKVYLYGIDAAVARQYGYTVVATPQEADVALLRVAAPYEILHPNYIFGSMQHEGRLNFVDGDADYEAIKNAARLAPKTVVTVYLDRPAILGNVQDKASAIIGNFGVSDGALFDVLTGKAKPQGKLPFELPSSMAEVQVQKSDVPYDTARPLYKFGYGLAY

SEQ ID NO: 227 - DNA, 1314 bp, Unknown
  Obtained from environmental sample
atgaccgatcgtgatgtttcgcgccgtgcgctgctgtccctggcggcggtcgccgccgcgaccccggccgtagccgctggccaggccaagccagccggcaacatgcccaaggacttcctgtggggcgcggccaccgccggtcaccaggtcgagggcaacaacgtcaacagcgacatctggctgctggagcagttgaagcccggcccgttcatggagccgtccggcgacgcctgcgaccactatcatcgctatgccgacgacatcgccatgttggcgaagctgggcttcaacacctatcgcttctcgctggaatgggcgcggatcgagccggccaagggccagttctcggccgccgagctgaaccactaccgccaggtcgccgccacttgccgcaagcatggcgtgacgccggtggtcaccttcaaccacttcaccgtgccgcgctggttcgcggcccagggcggctgggagaacccggagtcgccggcgctgttcgcgcgctattgcgactacgcggtcaagggcatcggcgacctgatcggcgtggcggcgaccttcaacgagccgaacatcggcatgctgctggtgtggatgctgccgccgttcatcctggaccagatgaagcaggccatggccgacgcggccaaggcctgcggcagcgccaccttctccagcgcccagttcggtcgccaggacgtcatgatgcccaatctgatcgaggctcaccgcctgggttatgcggcgatcaaggccggccccggcgacttccccgtcggcgccaccgtggcgatgatggacgaccaggcggtcggcccaggcagccgccgcgacgagaagcgggcccagtgctacacgccgtggctcgacatgctgaaggccaccggcgacttcgtgggcgtgcagacctacagccgcgcccgcgtcgacgccaagggccagatgcacccgcccgagggcgccgaactgacccagaccggcgaggagttctggccccaggcgctggagcagaccatccgctacgcccacgccgccacgggcaagccgatctatgtcaccgagaacggcgtctcgaccgagaacgacgcccgccgcgtcgcctacatccagaccgctctgcagggcgtgaaggcctgcctggccgacggcgtgccggtgcgcggctacatccactggtcgctgatggacaatttcgagtgggtgttcggctacgggcccaagttcggcctggtcgccgtcgaccgcgccacccaggtccgcacgcccaagcccagcgccgtgctgctgggctccatcgcccgcgccaaccggatctga

SEQ ID NO: 228 - protein, 437 aa, Unknown
  Obtained from environmental sample
  SIGNAL (1)...(25)
  DOMAIN (31)...(437): Glycosyl hydrolase family 1
  SITE (354)...(362): Glycosyl hydrolases family 1 active site. Prosite id = PS00572
MTDRDVSRRALLSLAAVAAATPAVAAGQAKPAGNMPKDFLWGAATAGHQVEGNNVNSDIWLLEQLKPGPFMEPSGDACDHYHRYADDIAMLAKLGFNTYRFSLEWARIEPAKGQFSAAELNHYRQVAATCRKHGVTPVVTFNHFTVPRWFAAQGGWENPESPALFARYCDYAVKGIGDLIGVAATFNEPNIGMLLVWMLPPFILDQMKQAMADAAKACGSATFSSAQFGRQDVMMPNLIEAHRLGYAAIKAGPGDFPVGATVAMMDDQAVGPGSRRDEKRAQCYTPWLDMLKATGDFVGVQTYSRARVDAKGQMHPPEGAELTQTGEEFWPQALEQTIRYAHAATGKPIYVTENGVSTENDARRVAYIQTALQGVKACLADGVPVRGYIHWSLMDNFEWVFGYGPKFGLVAVDRATQVRTPKPSAVLLGSIARANRI

SEQ ID NO: 229 - DNA, 1455 bp, Unknown
  Obtained from environmental sample
atgaatcgccgcgaactgctcgcctccaccctggccttcagtgccgcctcggccctgcctgccgccgcccgtgaaaaggcgttcgtgccgggcaccttcccgccgggcttcctgtggggcgccgccaccgccgcctaccaggtcgagggcgcctataacgaggatggcaaaggcgaatccgtctgggaccgcttcgtgctggcgccgggcaagatcaaggaaggccacaccggcaacgtcgcctgcgacagctaccacaaatatgccgaggatatcgccctgctgaaggcgatgaacctgaagacctaccgcttctcgaccgcctggacgcgcatccagcccgatggcaccggcccggccaatccgaaggggctcgactactattcgcgcctgaccgacgccttgctggaggccggcattcgtccgatgccgacgctctatcactgggatctgccgcagaacctcgaagacctcggtggctggcccaaccgcgacacggcctggcgctatgccgactatgccgatatcatggtgcgagcgctgggtgaccgtatcgagaactggtcgctgttcaacgaatccaagaccttcaccggcctgggctacaatgtcggcatcttcgcgccgggacggaaagacccttacgcctttatccgctcgacccacacggtcaacctggcgcacggcctgggctacaaagcgatcaaggcggccaatccgaagctgaaggtcggcagcgtctatgacgtcacgccgatgatcccggcctcgcaatccgaggccgatgtccgcgccgccgatatctgggacaagtggcagaacctgtggttcgtcaacaccaccctgaccgggcagtatccggaaggcgtcttcccggtggacaaacaggaagccctgctcggctaccaggccggcgacgatgcgatcatgaaggccgatctcgatttcgtcgggctcaactactattccggcacgctgtgttcgtatggcaaggaggccagcggcgtgccctttatcgacgtcaacgcccagtggccctacgccacgccggacaaggatatgggccggaccgacttcaactgggcggtctatccgcaggggttctacgatatcctgacgcgcatgcacaaggtcaccggcgaccggccgatcgagatcaccgaaaacggctgtgcctataatgtcggtcccgacgctaccggccagatccacgatccgaagcgcatcgatttctacaagggccacttcgaggcgatgtcgcgcgccatccatgacggcgtgccggtgcgcggctatcacgcatggagcctgatggacaatttcgagtgggcttcgggttacaccatgcgtttcggcctgacctatgtcgatttcgacaacggccagacgcgcacgatcaaggattccggcaagtggtacgcccaggtcgccaaggccaattcgagcaatctgtaa

SEQ ID NO: 230 - protein, 484 aa, Unknown
  Obtained from environmental sample
  SIGNAL (1)...(23)
  DOMAIN (29)...(482): Glycosyl hydrolase family 1
  SITE (37)...(51): Glycosyl hydrolases family 1 N-terminal signature. Prosite id = PS00653
  SITE (189)...(192): N-glycosylation site. Prosite id = PS00001
  SITE (194)...(197): N-glycosylation site. Prosite id = PS00001
  SITE (283)...(286): N-glycosylation site. Prosite id = PS00001
  SITE (487)...(490): N-glycosylation site. Prosite id = PS00001
MNRRELLASTLAFSAASALPAAAREKAFVPGTFPPGFLWGAATAAYQVEGAYNEDGKGESVWDRFVLAPGKIKEGHTGNVACDSYHKYAEDIALLKAMNLKTYRFSTAWTRIQPDGTGPANPKGLDYYSRLTDALLEAGIRPMPTLYHWDLPQNLEDLGGWPNRDTAWRYADYADIMVRALGDRIENWSLFNESKTFTGLGYNVGIFAPGRKDPYAFIRSTHTVNLAHGLGYKAIKAANPKLKVGSVYDVTPMIPASQSEADVRAADIWDKWQNLWFVNTTLTGQYPEGVFPVDKQEALLGYQAGDDAIMKADLDFVGLNYYSGTLCSYGKEASGVPFIDVNAQWPYATPDKDMGRTDFNWAVYPQGFYDILTRMHKVTGDRPIEITENGCAYNVGPDATGQIHDPKRIDFYKGHFEAMSRAIHDGVPVRGYHAWSLMDNFEWASGYTMRFGLTYVDFDNGQTRTIKDSGKWYAQVAKANSSNL

SEQ ID NO: 231 - DNA, 1128 bp, Unknown
  Obtained from an environmental sample
atgaccgaccacaacgcttccgaaaccagcctgttcgaacagtgcggctacagccgcgaggccatccaggcccgcctggagcgcaactggtatgagatgttcgaaggcccggacaagatttactgggagaacgacgaaggcctggggtacgtgatggacaccggcaaccacgacgtgcgcaccgagggcatgagctacgcgatgatgatcgccgtgcagtacggccgcaaggacgtgttcgacaagctgtggggttgggtcatgaaatacatgttcatgaccgagggcctgcaccagggctacttcgcctggtctgtggaccccagcggcgtaccgaacgccgacggtccggccccggacggcgaggaatacttcgcgatggacctgttcctggcctccgcgcgatggggcgacggcgaaggcgtgtacgagtactcccgccacgcccgctcgatcctccacacctgcgtgcaccagggcgaggacggtgaaggctatccgatgtggaacccggagaaccatctgatcaagttcatcccggaaaccgaatggaccgacccgtcctaccatctgccgcacttctacgaggtgttcgccgagcgcgccgacgaggccgaccgtccgttctgggcgcaggccgccaaggcgagccgcgagtacctggtcaccgcctgccacccgcagaccggcatgaaccccgaatactcaaactatgatggcacgccgcacgtcgacgagcgcgaccactggcatttctactccgacgcctaccgcaccgccggcaacatcgggctggactgcctgtggaacggcgtcgtgccggaactgtgcgatgcgaatgcgcgtctgcagcgtttcttcctcgaacacgaccgcacctgcgtgtatgcgatcgacggcacgccggtggacgagaccgtgctgcacccggtcggcttcatcgccgccaccgccgaaggctcgctcgccgcgatgcactcgcaggagccggacgcgctcgacaacgcgatccgctgggtgcgcctgctgtgggacaccccgatccgcaccggcacgcgccgctactacgacaacttcctctacgccttcgcgttcctggcgctggcgggggagtaccgcacctggtga

SEQ ID NO: 232 - protein, 375 aa, Unknown
  Obtained from an environmental sample
  DOMAIN (22)...(370): Glycosyl hydrolases family 8
  SITE (5)...(8): N-glycosylation site. Prosite id = PS00001
MTDHNASETSLFEQCGYSREAIQARLERNWYEMFEGPDKIYWENDEGLGYVMDTGNHDVRTEGMSYAMMIAVQYGRKDVFDKLWGWVMKYMFMTEGLHQGYFAWSVDPSGVPNADGPAPDGEEYFAMDLFLASARWGDGEGVYEYSRHARSILHTCVHQGEDGEGYPMWNPENHLIKFIPETEWTDPSYHLPHFYEVFAERADEADRPFWAQAAKASREYLVTACHPQTGMNPEYSNYDGTPHVDERDHWHFYSDAYRTAGNIGLDCLWNGVVPELCDANARLQRFFLEHDRTCVYAIDGTPVDETVLHPVGFIAATAEGSLAAMHSQEPDALDNAIRWVRLLWDTPIRTGTRRYYDNFLYAFAFLALAGEYRTW

SEQ ID NO: 233 - DNA, 993 bp, Unknown
  Obtained from environmental sample
gtgtttgctactaccgaacccgccaagaaactgctggcttatctatggtcgcagtatggcagcaagaccatctcgagcgtcatggccgaggtgaactggaatcatcgtctggcagactatgtgaaaggcgtgaccggtaaatatccggccatgaactgctatgacttcatccagatctatgttcccgagaacaactggatcaactacaacgatataacgcctgtcagggagtggttcgacgccggtggtatcgtccagctcatgtggcacttcaacgtgcccctcaccgagagcaccgtgcccggtagcgatggctcaggcgtaacctgtacgcctagtcagaccactttcaaggcatccaatgccctgaccagcggcacgtgggaaaaccagtggttctatggccagatggacaaggtgattgacgtcttgctcaagttgcaggatgcaggcatcgccgccatgtggcgccccttccacgagggcgcaggcaatgcgtgtgccaagcaacaggcctcctggaccacggcttggttctggtggggatatgacggcgccgatacctacaagaagttgtgggttgccatgtttgactacttcaagcagaagggcgtgaaaaacctcatttgggtatggaccactcagaattacaacggcgacagctctaaatacaaccaggacaccgattggtatccaggcaacgaatatgtcgatatcattgcccgcgacctgtacggctacaacgccgcccagaacaagcaggagtttgatgagatccaggctacctatagcggcaagatggtgatcctgggcgagtgtggagctgacggtaacaccagcttcgccaacatcgccgacgtctggggtgccggagccaagtggggttcgttcatggtgtggtatggcatcaacttttgcagcgacgcctggtggaagaacgccatgagcaatgcctatgtcattacccgcgagcagctgcccgacctcaagtaa

SEQ ID NO: 234 - protein, 330 aa, Unknown
  Obtained from environmental sample
  DOMAIN (5)...(325): Glycosyl hydrolase family 26
  SITE (282)...(285): N-glycosylation site. Prosite id = PS00001
MFATTEPAKKLLAYLWSQYGSKTISSVMAEVNWNHRLADYVKGVTGKYPAMNCYDFIQIYVPENNWINYNDITPVREWFDAGGIVQLMWHFNVPLTESTVPGSDGSGVTCTPSQTTFKASNALTSGTWENQWFYGQMDKVIDVLLKLQDAGIAAMWRPFHEGAGNACAKQQASWTTAWFWWGYDGADTYKKLWVAMFDYFKQKGVKNLIWVWTTQNYNGDSSKYNQDTDWYPGNEYVDIIARDLYGYNAAQNKQEFDEIQATYSGKMVILGECGADGNTSFANIADVWGAGAKWGSFMVWYGINFCSDAWWKNAMSNAYVITREQLPDLK

SEQ ID NO: 235 - DNA, 999 bp, Unknown
  Obtained from environmental sample
atgagacctgtcatccttgctgccatcaccatggctttatccctctttgtctcctgctcatccggcgaaggctgggtaaaggtggaaggaaataaattcatagaccctcagggaaaggaactggtgttccgcggcctctgcttctcggatcctgtgaaactggtccgtgacgggcagtggaatgagcgttatttcgcggaggcggcggcctggggagccaatgtggtccgtttcgccgtccatcccaccaacctgaactccatgggctgggaagagaccttccaggccatggaccagggcattgcgtgggccaaacagcatgggatgtatgttatcatggactggcacaccatcggcaacctgaaggaggagaagtttacttctcccatgtacaggaccacccgggaggagacgttcaagttctggcgcaccgtagccaggcgttacaaggacgagccggcggtggcgctgtacgaactcttcaacgaacccaccgtcaccgcagagggggttggttcctgcacctggaccgaatggaaagaactgcaggagcagatcatagataccgtgcgcacatataacccccgggccgtgtgcctttgcgccggattcaattgggcgtacgaccttacgccggtggcttcggagcccatagcccgtcccaacgtggcctatgtatcccacccgtatcccatgaaacgggaacagccctgggaaggacagtgggagaaagacttcggctatgtggccgatacttaccccgttatctgcacggagattggattctgcctgccggatgaacccggtgcccatatcccggtgatgtccacggaggtgtatgggcagcacataacccaatactttgaaaagaagggcatctccttcacggtatggtgctttgataccagctgggcgcccacgctaatcagtgactgggactttacgcccaccacccagggccgcttcttcaaagactatctgcagaataagcagccctag

SEQ ID NO: 236 - protein, 332 aa, Unknown
  Obtained from environmental sample
  SIGNAL (1)...(21)
  DOMAIN (31)...(308): Cellulase (glycosyl hydrolase family 5)
MRPVILAAITMALSLFVSCSSGEGWVKVEGNKFIDPQGKELVFRGLCFSDPVKLVRDGQWNERYFAEAAAWGANVVRFAVHPTNLNSMGWEETFQAMDQGIAWAKQHGMYVIMDWHTIGNLKEEKFTSPMYRTTREETFKFWRTVARRYKDEPAVALYELFNEPTVTAEGVGSCTWTEWKELQEQIIDTVRTYNPRAVCLCAGFNWAYDLTPVASEPIARPNVAYVSHPYPMKREQPWEGQWEKDFGYVADTYPVICTEIGFCLPDEPGAHIPVMSTEVYGQHITQYFEKKGISFTVWCFDTSWAPTLISDWDFTPTTQGRFFKDYLQNKQP

SEQ ID NO: 237 - DNA, 2712 bp, Unknown
  Obtained from environmental sample
atggcgacagctagagcacgagcagatatatctaccacaccagtcacagcctcgacagatgctgccaagaacctgtatgcctatttcctggaccagtatggcaagaagacgatttccagcgtcatggccaatgtcaactggaacaacacttgtgccgagaaagtctataaactcacgggcaagtatcctgccatgaactgctacgacttcatccacatctgtttctcgccagccaactggattgactacaccgacatcactcctgccaaggaatggcacgatgcgggcggtatcgtacagttgatgtggcatttcaatgtgcctaagagccagggggcaacagatgttacctgcacgcccagcgagaccacctttaaggcttccaatgctctggttagcggcacgtgggagaacaaatggttctacgagcagatggacaaggtcattgccaccatcctcaagttacaggacgctggcattgccgctacctggcgacctttccatgaggcagcaggcaatgcttgcgccaagcagcaggccgactggaccaaagcatggttctggtggggctacgacggtgccgacacctacaagaaactgtggattgccatgtacgactatttcaagctgaaaggcgtgaacaacctcatctggatgtggaccacccagaattataatggtgacagcagcaaatacaaccaggacaccgactggtaccctggcgacgagtatgttgacatcgtggcccgcgacctctatggctacaatgccgaccagaacctgcaggagttcagcgagattcaggctgcctatcccaacaagatggtggttctgggtgaatgcggaaaaggtgatagcggcgaccccggcaagatgtccgatgtatgggcgaaaggtgccaagtggggccacttcatggtatggtatcaaggcgaacaaggctctaccgacacgatgtgcagcgacgactggtggaaggatgccatgagcagcgccaacgtcatcacccgcgacaaggtggttatccccgatgtcacttcaaccatcgagaatgccacggatgccgtgaagaacatgggactggggtggaacctggggaacgccctcgacgccaatgcccagcaataccatgatgccacccaggacaactactggggacagcaggacattacctctgagagctgctggggtcagctacccaccaaggcagagctgatggccatgatgaaagaagccggtttcggagccatccgcgttcccgtgacatggtataaccacatggacaaggacggcaatgtggatgcagcatggatgaatcgtgtgcatgaggtggttgactatgtcatcagccagggaatgtactgcatcctcaacgtacaccacgacacgggtgccgacagctacgacagccagaagaacctcaccggctaccattggatcaaggccgacgaaaccaactacgccaccaacaaggcccgctatgagaagctgtggcagcagatagcccaggagttccgcaactacggccagctgctgctgttcgagggctataacgagatgctcgatgccaacaactcctggaattttgcacagagcagttcagcctacgatgccatcaacaaatacgcccagagctttgtcgatgtcgtacgcgccaccggtggcaacaatgcccagcgcaacctcattgtcagcacatacggcgcctgctcaggcaacggcacgtgggatgcaagagtgcaagaccccttgaagaaactgcagattcccacgggtgaaagcaaccatatcatcttcgaggttcacaactatccctccatcgtcaacaaggacaacgcgggcaactacgtcagcgatcgcaccatcagcgaaatcaaggcagagattgatgcatggcttaagaacttaaagacccacctcgtcagcaagggcgctcccgtcatcatcggcgaatggggcaccaacaacgtcgatgccggcggtggcaagacagactacgacctccataaggacctgatgttcgaatttgtcagctacatgataaagaccatgaagcagaacgacattgccaccttctactggatgggacttaccgacggcgctccacgcacctaccccgccttcacacagcccgacctggcgctgaagatgctgcaggcctatcacggcgactcttggaatccctacctgcctgacgccaaggactttcccgaaggcaaaatcacctcggccacggtgaatttcaacagccaatggggcgaactgaccatccacgatggagctattgacaagaccgtctatagaggtatcaaggtggagctggaagaaaagcctgccactggagccctgtctttcaaggtatatgccaacagtgagaaggcaacagccatcaattccaaaaccccacagttggctttcttcagttacacaggcatccagaaaatcaacctacagtggaacatagccaccaaggggagtatcaaaatcaagagcgtcaaccttatcaagcacgacgactccacagaaccctgtagtctgaaagtggcttggggttgtactctcagcgaccagaactacgccacgggcatcgaagacattactatcactcctgttcgtcatgacgatggaatcatctacaatctgagcggacagcctgtaacctctcctcagcgcggcatctacatcctcaacggaaagaaaatcatcaaatag

SEQ ID NO: 238 - protein, 903 aa, Unknown
  Obtained from environmental sample
  DOMAIN (15)...(339): Glycosyl hydrolase family 26
  DOMAIN (366)...(705): Cellulase (glycosyl hydrolase family 5)
  SITE (48)...(51): N-glycosylation site. Prosite id = PS00001
  SITE (356)...(359): N-glycosylation site. Prosite id = PS00001
  SITE (480)...(483): N-glycosylation site. Prosite id = PS00001
  SITE (532)...(535): N-glycosylation site. Prosite id = PS00001
  SITE (581)...(584): N-glycosylation site. Prosite id = PS00001
  SITE (893)...(896): N-glycosylation site. Prosite id = PS00001
MATARARADISTTPVTASTDAAKNLYAYFLDQYGKKTISSVMANVNWNNTCAEKVYKLTGKYPAMNCYDFIHICFSPANWIDYTDITPAKEWHDAGGIVQLMWHFNVPKSQGATDVTCTPSETTFKASNALVSGTWENKWFYEQMDKVIATILKLQDAGIAATWRPFHEAAGNACAKQQADWTKAWFWWGYDGADTYKKLWIAMYDYFKLKGVNNLIWMWTTQNYNGDSSKYNQDTDWYPGDEYVDIVARDLYGYNADQNLQEFSEIQAAYPNKMVVLGECGKGDSGDPGKMSDVWAKGAKWGHFMVWYQGEQGSTDTMCSDDWWKDAMSSANVITRDKVVIPDVTSTIENATDAVKNMGLGWNLGNALDANAQQYHDATQDNYWGQQDITSESCWGQLPTKAELMAMMKEAGFGAIRVPVTWYNHMDKDGNVDAAWMNRVHEVVDYVISQGMYCILNVHHDTGADSYDSQKNLTGYHWIKADETNYATNKARYEKLWQQIAQEFRNYGQLLLFEGYNEMLDANNSWNFAQSSSAYDAINKYAQSFVDVVRATGGNNAQRNLIVSTYGACSGNGTWDARVQDPLKKLQIPTGESNHIIFEVHNYPSIVNKDNAGNYVSDRTISEIKAEIDAWLKNLKTHLVSKGAPVIIGEWGTNNVDAGGGKTDYDLHKDLMFEFVSYMIKTMKQNDIATFYWMGLTDGAPRTYPAFTQPDLALKMLQAYHGDSWNPYLPDAKDFPEGKITSATVNFNSQWGELTIHDGAIDKTVYRGIKVELEEKPATGALSFKVYANSEKATAINSKTPQLAFFSYTGIQKINLQWNIATKGSIKIKSVNLIKHDDSTEPCSLKVAWGCTLSDQNYATGIEDITITPVRHDDGIIYNLSGQPVTSPQRGIYILNGKKIIK

SEQ ID NO: 239 - DNA, 1035 bp, Unknown
  Obtained from environmental sample
atgagagatataagtcctgcagagctggttgccgagatgacaaccggatggaatcttggaaatacctttgatgcatatggaaaaggcggtcttgatgatgagacaggctggggaaatccctatactactaaggaaatgattgatgtagtctgtgaaaaggggtttaattctatcagaatcccaataacctgggctgatcatatgggtgctgctcctgactatacagtagatgaggactggatgaaccgtgtagaagaggttgtaaattatgctcttgatgacgggatgtatgtcattatcaattcccaccacgaagagtcctggagaatccctgatgatgcacacattgatgcagtagatgaacaggttggaaagctctgggtccagatagctgagaggttcagggattatggcgaccatcttatttttgaggggctaaatgagccacgtgttaagggcggtgaaaatgagtggaatggcggaacgaccgaaggacgtaaatgcctggacagacttaatcagacttttgtagattcagtaagatcaacaggtggaaataatgaaaaaagacttgtacttataacaagctttgcatcctcacacgtaatacagacaataggaagccttaaaattccaagcgacgatcaccttgctgtttcaatccatgcctatacgccttatgattttacatatgcctccggcacctcctctgagcttttaacctgggatggttccagaaaaagtgatattgcttctgttattggtgatgtaaaaagaatctttatagacaagggtattcctgtccttatgacagaatatggtgcagttgataaagatggcaactccggtgatgtaagcgcctgggtaactgagtatttaacacgcgcaaaaaaagccggtatcccatgcttttggtgggacaatggcctgtatgaatcaggtgatgaacattttgctatattcaaccgcaatgacctgacctggtacagagaagacgtcgttgatgccattatggctgtctactatgcccaataa

SEQ ID NO: 240 - protein, 344 aa, Unknown
  Obtained from environmental sample
  DOMAIN (20)...(316): Cellulase (glycosyl hydrolase family 5)
  SITE (1)...(4): Tubulin-beta mRNA autoregulation signal. Prosite id = PS00228
  SITE (143)...(152): Glycosyl hydrolases family 5 signature. Prosite id = PS00659
  SITE (175)...(178): N-glycosylation site. Prosite id = PS00001
MRDISPAELVAEMTTGWNLGNTFDAYGKGGLDDETGWGNPYTTKEMIDVVCEKGFNSIRIPITWADHMGAAPDYTVDEDWMNRVEEVVNYALDDGMYVIINSHHEESWRIPDDAHIDAVDEQVGKLWVQIAERFRDYGDHLIFEGLNEPRVKGGENEWNGGTTEGRKCLDRLNQTFVDSVRSTGGNNEKRLVLITSFASSHVIQTIGSLKIPSDDHLAVSIHAYTPYDFTYASGTSSELLTWDGSRKSDIASVIGDVKRIFIDKGIPVLMTEYGAVDKDGNSGDVSAWVTEYLTRAKKAGIPCFWWDNGLYESGDEHFAIFNRNDLTWYREDVVDAIMAVYYAQ

SEQ ID NO: 241 - DNA, 1107 bp, Unknown
  Obtained from environmental sample
atgaatgtgttgcgtagtggactcgtgacgatgctgctgctggctgcctttagtgttcaggcagcctgtacctggcctgcctgggagcagtttaaaaaggattacatcagtcaggaagggcgcgtcatcgaccccagcgacgcgcgcaaaatcaccacctccgaagggcaaagttacggcatgttctttgccctggcggctaacgaccgtgcagctttcgataatcttctcgactggacgcagaacaatctcgctcagggttctttaaaagaacatttgcccgcctggctgtggggcaagaaagagaacagtaagtgggaagtgctggacagcaattcggcctccgatggtgatgtctggatggcctggtcgttgctggaggcggggcgtttgtggaaagagcagcgttataccgacatcggcagcgcattgctaaaacgtatcgcgcgggaggaagtggtgacggtgcctgggctgggctccatgttgttaccgggcaaagtgggttttgctgaggataacagctggcgttttaaccccagctacctgccgccgacgctggcgcagtatttcacccgctttggcgcgccgtggaccacgctgcgcgaaaccaatcaacgtttattgctggaaaccgccccgaaaggcttttcgccagactgggtgcgctatgagaaagacaaaggctggcagctaaaagccgaaaaaacattgatcagcagctacgacgctatccgcgtttacatgtgggtaggcatgatgcctgacagcgatccgcaaaaagcgcggatgctcaaccggtttaaaccgatggcgacattcactgagaaaaacggttatccgccggaaaaagtggatgtggctacggggaaagcgcagggtaaaggaccggtcggtttttctgccgccatgctgccctttttacaaaaccgcgatgcgcaggccgttcagcgccagcgcgtggccgataactttcccggcagcgatgcctattacaactatgtgctgaccctgtttggacaaggctgggatcaacaccgtttccgcttctcgacaaaaggtgagttattacctgactggggccaggaatgcgcaaattcacactaa

SEQ ID NO: 242 - protein, 368 aa, Unknown
  Obtained from environmental sample
  SIGNAL (1)...(21)
  DOMAIN (1)...(346): Glycosyl hydrolases family 8
MNVLRSGLVTMLLLAAFSVQAACTWPAWEQFKKDYISQEGRVIDPSDARKITTSEGQSYGMFFALAANDRAAFDNLLDWTQNNLAQGSLKEHLPAWLWGKKENSKWEVLDSNSASDGDVWMAWSLLEAGRLWKEQRYTDIGSALLKRIAREEVVTVPGLGSMLLPGKVGFAEDNSWRFNPSYLPPTLAQYFTRFGAPWTTLRETNQRLLLETAPKGFSPDWVRYEKDKGWQLKAEKTLISSYDAIRVYMWVGMMPDSDPQKARMLNRFKPMATFTEKNGYPPEKVDVATGKAQGKGPVGFSAAMLPFLQNRDAQAVQRQRVADNFPGSDAYYNYVLTLFGQGWDQHRFRFSTKGELLPDWGQECANSH

SEQ ID NO: 243 - DNA, 1290 bp, Unknown
  Obtained from environmental sample
atgaaaagcaaagtgaaaatgttctttgcggctgccatcgtgtggagtgcatgtagttcaacaggatatgccgctgccattgagaaggagaagcacatgtcagagcttcggacagaggatctttttgttaaaaaagtagaggggatgaacaaggattttatcaaaggggcagatgtgtccagcgttattgctttggaaaatagcggagtcaccttttataatacaagcggaaaacgccaggacatctttacaaccttaaaacaggctggggtcaactatgttcgcgtccgcatctggaatcacccgtatgattcaaatggcaacgggtatggcgggggaaacaatgatgttcaaaaagccatcgaaatcggaaaaagagcgacagcgaacggaatgaaggtgctggccgactttcactactctgatttctgggccgatccagcgaaacaaaaggtgcccaaatcctgggtgaatctcagctttgaagcaaaaaaagggaagttctatgagtatacgaaacaaagcctgcaaaagatgatcaaggaaggcgttgacatcggcatggttcaggtcggaaatgaaacaacaggaggatttgccggtgagactgattggacgaagatgtgccaattatttaatgaaggaagccgagcggtcagggagacaaattcaaatattttggtcgccctgcattttaccaatcctgaaacggctggaaggtattcatttattgcggaaacactcagcaaaaacaaagtggattatgatgtgtttgcgagctcctattatcctttctggcatggcacattacaaaatttgacctccgtgctgaaggctgttgccaatacttacggcaaaaaagtcatggtggcggagacatcgtacacctataccgctgaggatggcgatgggcatggaaatacagcaccaaaaagcgggcagacgctgccatatccaatttctgttcaaggccaggcaactgcagtaagagatgtaatggaggcagtggcgaatacgggcaaagcaggacttggtgttttctactgggagcctgcgtggattccggtcggaccgaaaacacagatagagaaaaacaaagtgttatgggaaacatacgggtcagggtgggcttccagctacgctgctgaatacgaccctgaagacgccgggaagtggtatgggggaagtgctgtagataatcaagctttgtttgattttaatggacacccgctgccttccttgcaggtgtttcaatatgcggagtcaggacatattccaaagaaacgctga

SEQ ID NO: 244 - protein, 429 aa, Unknown
  Obtained from environmental sample
  SIGNAL (1)...(24)
  DOMAIN (54)...(417): Glycosyl hydrolase family 53
  DOMAIN (59)...(354): Cellulase (glycosyl hydrolase family 5)
  SITE (75)...(78): N-glycosylation site. Prosite id = PS00001
  SITE (160)...(163): N-glycosylation site. Prosite id = PS00001
  SITE (195)...(198): N-glycosylation site. Prosite id = PS00001
  SITE (276)...(279): N-glycosylation site. Prosite id = PS00001
MKSKVKMFFAAAIVWSACSSTGYAAAIEKEKHMSELRTEDLFVKKVEGMNKDFIKGADVSSVIALENSGVTFYNTSGKRQDIFTTLKQAGVNYVRVRIWNHPYDSNGNGYGGGNNDVQKAIEIGKRATANGMKVLADFHYSDFWADPAKQKVPKSWVNLSFEAKKGKFYEYTKQSLQKMIKEGVDIGMVQVGNETTGGFAGETDWTKMCQLFNEGSRAVRETNSNILVALHFTNPETAGRYSFIAETLSKNKVDYDVFASSYYPFWHGTLQNLTSVLKAVANTYGKKVMVAETSYTYTAEDGDGHGNTAPKSGQTLPYPISVQGQATAVRDVMEAVANTGKAGLGVFYWEPAWIPVGPKTQIEKNKVLWETYGSGWASSYAAEYDPEDAGKWYGGSAVDNQALFDFNGHPLPSLQVFQYAESGHIPKKR

SEQ ID NO: 245 - DNA, 3069 bp, Unknown
  Obtained from environmental sample
atggggaagatcagtaagtattttgctatgtttttagcatttctaatggtgtttagttcattattcgtaaattttcaaccaaggaatgttcaagctgccacaccatctttggtaaatggcgggtttgaatcggacttttgggctgatggttcatggagtgttgaagcggcggtttgggatcatcttgatttacagcatttttcttattccggagattcatggatgaagaaggatgagggagagcatgcttttaagtattggattaaagacagtgctggcgaaaatcaggcatttacggttaaacagactatagccacacttccagctggaagctacgaactatcgatccattctatgggtggtgcaggtactgaagcgggttctgtacaactatttgccggaaatgaaaagacagaggcatcagttacgtccggctataataactggggaacgatcacgttgaattttgaagtaagtgaagatgtttccaattttgaggtaggtgcgattgtgagtggtgcgccaaaggcttggggctatttagatagcgtaagcttaaagtcactgaatacgagtgttcctgatccagtagaagcagatatttttgtagaaagagtagacggtatcagcgagcattttattaaaggtgtcgatgtttctagtattatttcgctagaaaacagtggtgtcacatttaaaaatgaagcaggtgctgaacaggatatttttaaaacattagcggattcaggcgttaactatgtccgtgttcgtgtctggaacgacccgtttgacgctgcaggaaatggttatggcggagggaacaatgatttacaaacggcgatagaaattggaaaaagagctacagcaaatggaatgaagctattagtagacttccattattctgatttctgggcagaccctgctaaacagcaagcaccaaaggcttgggcaaccttaagcttcgaagataagaaaaaagctttatatgactatacaaaagatagcctgcaagcaatgaagaatgcgggaattaatattggtatggtacaagttgggaatgaaaccaatggtggtgttgcaggagagaaagattggacaaagattagtgctttatttaatgaaggaagtaaagcagttagatcgatagatccgaatatcttagtagccgtgcactttacgaaccctgaaacagcaggaagatatacatccatagctaaaactcttcaggataacggtgtagactatgatgtatttgcgagctcgtattatccattctggcatggtacattaagcaatttaacgactgttttaaagaatgttgccgatacgtacggcaagaaagtaatggttgctgaaacttcctatgcatatacagctgaagatggagacggccatggtaacacagcaccgaaggattctggtcagactttaaattacccgattactgttcagggacaagctaattccgttagagacgtaattgaagcggttgtcaatgttggtgaagcgggaatcggtgtgttctattgggaaccagcatggcttcctgttggtccagcttctcagcttgagcaaaataaagcaatctgggaacagtatggttctggctgggctagcagttatgctgccgaatatgatccgcatgacgcaggcgcgtggtatggcggaagtgcagtagacaaccaggcattatttgatttcaccggtaaaccattagcttcattaaatgtatttaactatgttaatacaggtgctgttgctccattaagaattgatgaaattaaagatgtcactgttaatgcgattttaggagaagaaattacattaccggaaactgttaccgttacgtataataatggattaacgggaaaggcttctgtcacatgggatggtgcagcactggaacaagccatcagcaagggtgttggaagatacgtaattgaaggtcaagttgaaggtggagggggtgtcaaagcacgccttaccattaatcctaaaaattatgttgtaaaccctggctttgaaaataaagatcgttcgatgtggaagattagttatggaaatagttctaccccatatgtttcatatcaacaaaaggcttctgacgcgaaatctggggaatatgctctccatttttactcaggttcaggtgttaatttcaacgtagagcaaacgattacaggcttagaaccagggtattataatctttctatgtttcttcaaggcggagatgcgcataacccagaaatgtatttgtatgcaaaaacgggtggagaagaactaaaagatgatacaggtgtaaatggctgggttgtttggagcaatccacaaattaatgaaattcttgttgtagatggaaccattaccattggtgccagcatcaaagcagatgcaggtgcatggggaacgctagacgatttctatttataccgtgtacgtgattacgacaacaaagcacctgaaactaatgtggtcctttcaggacaagactataatggctggtacaaccaggatgttaacgttactctgaatgctgcggatgatcagtctggagtagcgaaaactgagtaccgcgtaaataatggtgattggcaaacctatcagggaccatttgaagtaagtacggaaggggcgaatgttgtccaatacagaagtacggacaaagatggtaatgttgaagaaactcaatcggttacagcgaaaatggataaaactgttccgacattggatgtttcgtttaacaaggccattataaccgaccgaaaccatgctcttattccaattaaagcttcggtggttggtgcagataccctttcagggattagcagaattgagttaatatcagttgaaagcaatcaaccggataatgggaaaggcgacgggaatacagaccaagatattcagggaacatactttggaacatttgatactgattatctgctaagagcagaaagaagtggaagcggagacagagtttatactgtaacctataaggcgtgggatcaagccggaaattccgttatccagtctaaacagattattgttaagcatgataactcgaaaaaatag

SEQ ID NO: 246 - protein, 1022 aa, Unknown
  Obtained from environmental sample
  SIGNAL (1)...(32)
  DOMAIN (214)...(578): Glycosyl hydrolase family 53
  DOMAIN (216)...(520): Cellulase (glycosyl hydrolase family 5)
  DOMAIN (594)...(654): Bacterial Ig-like domain (group 4)
  SITE (192)...(195): N-glycosylation site. Prosite id = PS00001
  SITE (358)...(361): N-glycosylation site. Prosite id = PS00001
  SITE (438)...(441): N-glycosylation site. Prosite id = PS00001
  SITE (698)...(701): N-glycosylation site. Prosite id = PS00001
  SITE (746)...(749): N-glycosylation site. Prosite id = PS00001
  SITE (852)...(855): N-glycosylation site. Prosite id = PS00001
MGKISKYFAMFLAFLMVFSSLFVNFQPRNVQAATPSLVNGGFESDFWADGSWSVEAAVWDHLDLQHFSYSGDSWMKKDEGEHAFKYWIKDSAGENQAFTVKQTIATLPAGSYELSIHSMGGAGTEAGSVQLFAGNEKTEASVTSGYNNWGTITLNFEVSEDVSNFEVGAIVSGAPKAWGYLDSVSLKSLNTSVPDPVEADIFVERVDGISEHFIKGVDVSSIISLENSGVTFKNEAGAEQDIFKTLADSGVNYVRVRVWNDPFDAAGNGYGGGNNDLQTAIEIGKRATANGMKLLVDFHYSDFWADPAKQQAPKAWATLSFEDKKKALYDYTKDSLQAMKNAGINIGMVQVGNETNGGVAGEKDWTKISALFNEGSKAVRSIDPNILVAVHFTNPETAGRYTSIAKTLQDNGVDYDVFASSYYPFWHGTLSNLTTVLKNVADTYGKKVMVAETSYAYTAEDGDGHGNTAPKDSGQTLNYPITVQGQANSVRDVIEAVVNVGEAGIGVFYWEPAWLPVGPASQLEQNKAIWEQYGSGWASSYAAEYDPHDAGAWYGGSAVDNQALFDFTGKPLASLNVFNYVNTGAVAPLRIDEIKDVTVNAILGEEITLPETVTVTYNNGLTGKASVTWDGAALEQAISKGVGRYVIEGQVEGGGGVKARLTINPKNYVVNPGFENKDRSMWKISYGNSSTPYVSYQQKASDAKSGEYALHFYSGSGVNFNVEQTITGLEPGYYNLSMFLQGGDAHNPEMYLYAKTGGEELKDDTGVNGWVVWSNPQINEILVVDGTITIGASIKADAGAWGTLDDFYLYRVRDYDNKAPETNVVLSGQDYNGWYNQDVNVTLNAADDQSGVAKTEYRVNNGDWQTYQGPFEVSTEGANVVQYRSTDKDGNVEETQSVTAKMDKTVPTLDVSFNKAIITDRNHALIPIKASVVGADTLSGISRIELISVESNQPDNGKGDGNTDQDIQGTYFGTFDTDYLLRAERSGSGDRVYTVTYKAWDQAGNSVIQSKQIIVKHDNSKK

SEQ ID NO: 247 - DNA, 2958 bp, Unknown
  Obtained from environmental sample
ttggtgaatgggggatttgaatcagatttttgggatgatgaatcatggaaagttgaagcacctgtttggaatcatcttgatttacaatacttttcctattccggagatccatatattaagaaggatgaaggtgagcatgcatttaaatattggattaaagaaacggcaagcgaaacccaatcatttactgttaagcagactctagcaaaacttccagccggaagctacgaactaacaatccattctatgggtggtgcaggtacggaagcgggatctgtaaaactatttgctggaaatcaaatgacaaatgcagaagcaactacaggctataataactggggaacaattacgctgaattttgaggttagtgaagaagtttcaaattttgaggtgggtgccattgtgagtggtgcaccaaaggcttggggctatttagatagcgtaactttaaagtcgctgaatgctagcatccctgatccagtggatgctgatatttttgttgaaagagtagacggtatcagtaaggactttattaaaggtgtagacgtttcgagtatagtttcattagaaaacagtggcgtaacatttaaaaacgaagcaggcgcagaacaagatatttttaagacgttagcggattctggcgttaattatgtacgcgttcgcgtctggaacgatccatttgatgctgctggaaacggttatggcggcggaaacaacgatttagcaactgcgattgaaattgggaaaagagcaacagcaaatggaatgaagttattagtagacttccattactctgatttctgggcggaccctgctaaacagcaagcaccaaaggcttgggcaaacttaagttttgaagataagaaaaccgctttatacaactatacaaaagaaagcctagaagcgatgaaggctgcaggaattaacattggtatggttcaggttgggaatgaaacaaatggtggagttgcgggagagaaggagtggacaaaggttagtgcactcttcaatgagggtagtaaagcgattagagccgtagattctactattttagtagcggtacattttacaaatccggaaactgcaggaagatatgcctctttagcaaaaacacttcatgataacggagtagactatgatgtctttgccagctcttattacccattctggcatggtaccttaagtaatttaacggctgttctgaaaaatgttgccgatacctatggcaaaaaggtaatggtcgccgaaacctcttatgcgtatacagctgaagatggagatggccacggaaacacagcaccgaaggattccggtcaggtattaaattacccgattactgttcaaggccaagcgaattcggttagagacgtaatccaagcagttgctaatgttggagaagcgggaattggtgtgttttattgggaaccggcatggcttccagttggtccagctactcagtttgagcaaaataaggcaatctgggaaaagtatggttctggttgggcaactagcttcgctggggaatatgatccacatgatgcaggtgcgtggtatggcggaagtgcagtagataaccaagctttgtttgatttcactggtaaaccattaccttcattaaacgtgtttaactatgtcgatacgggagcagttgcaccgttaaaaatcgatgaaattaaagatgttaccgtaagtgcaattctaggagaagatattactttacctgaaacggtaacagttacctataataatggaacaaaaggctcgacttctgttacttgggatggacctgcacttgaacaagcgattaacagcggtgctggaaagtatgtaattgaaggcgtagttgaaggtggatcgactgtaaaagcacatcttaccatcaatcctaaaaattatgtggtaaaccctggctttgaaaatagtgatcgagcaatgtggaaggttagttatggaaatggaactcagccacatacttcattccaaaaaaaggcttcagacgcgaaatcaggagaatatgctttacatttttactcagataaaggtgtggatttcaaagtagagcaaaccattacaggtttagaaccaggttattacaacctttcaatgttcctgcaaggtggggacgcagcgaacccagaaatgtacttgtttgcgaaaactggtgaaaaagaactaaaagccaatacctccgtaaacggctgggtaaattggagcaatcctcaaatcaaggagatccttgttctagatggaaccattaccatcggggcaaggatcaaagcaaacgcaggtgcatggggtacattagatgatttctatttatatcgcgtggatgttgacaccaaggcacccgtaacggaggcggccctttctgggcaagaccgtaatggatggtataacgagagtgtaaatgttactctgaatgcttcagatgataaatctggtgttgcaaaaacagagtataaacttaatacaggtaattggcaaacctatcaggggtcacttgatgtaagtgctgaaggagaaaatgtggttcagtacagaagtacagatctcttaggtaacgttgaagaagttcaatctgttacagtaaaaatcgataaaagtgctccaacattgaatgtgtcgtttaatacgagcgtcctaaccgatcgtaaccatgcgcttattccaattaaagcgttggttgaaggcgcagatactctttcagggctagagagaattgaactagtatccattacaagtaatcaaccagacaatggaaaaggtgatggggatacactccatgatattcagggagcagactttggaacctttgatactgattttctactaagagcagagagaagtggaagtggggatagagtttatactgtaacctataaggcatgggatcataccggaaactctgtgatccaatccaatcagattattgtaaagcttaataattcgaaaaaataa

SEQ ID NO: 248 - protein, 985 aa, Unknown
  Obtained from environmental sample
  DOMAIN (178)...(542): Glycosyl hydrolase family 53
  DOMAIN (180)...(484): Cellulase (glycosyl hydrolase family 5)
  DOMAIN (558)...(619): Bacterial Ig-like domain (group 4)
  SITE (156)...(159): N-glycosylation site. Prosite id = PS00001
  SITE (286)...(289): N-glycosylation site. Prosite id = PS00001
  SITE (298)...(301): N-glycosylation site. Prosite id = PS00001
  SITE (321)...(324): N-glycosylation site. Prosite id = PS00001
  SITE (402)...(405): N-glycosylation site. Prosite id = PS00001
  SITE (591)...(594): N-glycosylation site. Prosite id = PS00001
  SITE (662)...(665): N-glycosylation site. Prosite id = PS00001
  SITE (709)...(712): N-glycosylation site. Prosite id = PS00001
  SITE (739)...(742): N-glycosylation site. Prosite id = PS00001
  SITE (747)...(750): N-glycosylation site. Prosite id = PS00001
  SITE (811)...(814): N-glycosylation site. Prosite id = PS00001
  SITE (815)...(818): N-glycosylation site. Prosite id = PS00001
  SITE (819)...(822): N-glycosylation site. Prosite id = PS00001
  SITE (886)...(889): N-glycosylation site. Prosite id = PS00001
  SITE (890)...(893): N-glycosylation site. Prosite id = PS00001
  SITE (996)...(999): N-glycosylation site. Prosite id = PS00001
MVNGGFESDFWDDESWKVEAPVWNHLDLQYFSYSGDPYIKKDEGEHAFKYWIKETASETQSFTVKQTLAKLPAGSYELTIHSMGGAGTEAGSVKLFAGNQMTNAEATTGYNNWGTITLNFEVSEEVSNFEVGAIVSGAPKAWGYLDSVTLKSLNASIPDPVDADIFVERVDGISKDFIKGVDVSSIVSLENSGVTFKNEAGAEQDIFKTLADSGVNYVRVRVWNDPFDAAGNGYGGGNNDLATAIEIGKRATANGMKLLVDFHYSDFWADPAKQQAPKAWANLSFEDKKTALYNYTKESLEAMKAAGINIGMVQVGNETNGGVAGEKEWTKVSALFNEGSKAIRAVDSTILVAVHFTNPETAGRYASLAKTLHDNGVDYDVFASSYYPFWHGTLSNLTAVLKNVADTYGKKVMVAETSYAYTAEDGDGHGNTAPKDSGQVLNYPITVQGQANSVRDVIQAVANVGEAGIGVFYWEPAWLPVGPATQFEQNKAIWEKYGSGWATSFAGEYDPHDAGAWYGGSAVDNQALFDFTGKPLPSLNVFNYVDTGAVAPLKIDEIKDVTVSAILGEDITLPETVTVTYNNGTKGSTSVTWDGPALEQAINSGAGKYVIEGVVEGGSTVKAHLTINPKNYVVNPGFENSDRAMWKVSYGNGTQPHTSFQKKASDAKSGEYALHFYSDKGVDFKVEQTITGLEPGYYNLSMFLQGGDAANPEMYLFAKTGEKELKANTSVNGWVNWSNPQIKEILVLDGTITIGARIKANAGAWGTLDDFYLYRVDVDTKAPVTEAALSGQDRNGWYNESVNVTLNASDDKSGVAKTEYKLNTGNWQTYQGSLDVSAEGENVVQYRSTDLLGNVEEVQSVTVKIDKSAPTLNVSFNTSVLTDRNHALIPIKALVEGADTLSGLERIELVSITSNQPDNGKGDGDTLHDIQGADFGTFDTDFLLRAERSGSGDRVYTVTYKAWDHTGNSVIQSNQIIVKLNNSKK

SEQ ID NO: 249 - DNA, 1452 bp, Unknown
  misc_feature: Thermococcus AEPII1a DNA
atgaagttcccatctaactttctttttggctactcctggtcgggcttccagtttgaaatgggtttacctgggagtgaagttgagagcgactggtgggcatgggtccacgataaggagaacatcttctcgggcctagttagcggtgacctaccagagaacgggcctgcttactggcacctctacaagaaagaccacgacatagctgaaagccttggcatggacgcgataagaggcggaatcgagtgggcgaggatcttcccaaaacccacctttgacgtgaaggttgacgtggaaaaggacgaaaacgggaacataatctccattgacgtcccggagagcgcgatagaggagctagaaaagcttgccaacatggatgccctcaaccactaccgcgaaatctactcggactggaaggagaggggcaagaccttcatattgaacctctatcactggccccttcccctctggctccacgacccgataggcgttagaaagctcggccctgatagagctccctcgggctggctggacgagaggagcgtggtggagttcaccaagttcgctgcattcatcgcctaccacttggatgacctcgttgacatgtggagcacgatgaacgagccgaatgtggtttacgagcagggttacacgaggcctcagtcgggctttccaccgggttatctcagccacgaggccgctggaaaggcgaagctcaacctcatgcaggctcacgctagagcttacgatgcgataaaagagcactcggacaagcccgtggggttgatatactcctttgtctggcacgatgccctaaacgaggaagcggaggagattgtgaaggagataaggaggagacactacgacttcgtaaccggccttcactccggctcatcggagttcggggagagggaggacttcaaggggaagatcgactggataggcgtgaactactacactagggttgcttacgagatgaggaacggccgctttatggccctacccgggtacggctacatgtgcgagaggagtggttacgcaaaatccggaaggcccgcgagcgattttggctgggagacctatcctgagggcctcgaaaacgtcctgatggatctgaaggagctctacggcctgccaatgatggtgacggagaacgggatggcggatatggcagacaggcaccgctcttactacctcgtgagccacctcgcggctatccacagggcgatggagaagggtgccgacgttagggggtacctccactggtctctgaccgacaactacgagtgggcgcagggcttcagaatgcgctttgggctggtgatggtggacttcgagactaagaagcgctacataaggccgagcgcactcgtcttcagggagatagccacgcagaaggaaatacccgaagagctctcccacctagcgaacctcgaactggtaacgaagaagtag

SEQ ID NO: 250 - protein, 483 aa, Unknown
  DOMAIN (1)...(483): Thermococcus AEPII1a protein
  DOMAIN (1)...(467): Glycosyl hydrolase family 1
  SITE (7)...(21): Glycosyl hydrolases family 1 N-terminal signature. Prosite id = PS00653
MKFPSNFLFGYSWSGFQFEMGLPGSEVESDWWAWVHDKENIFSGLVSGDLPENGPAYWHLYKKDHDIAESLGMDAIRGGIEWARIFPKPTFDVKVDVEKDENGNIISIDVPESAIEELEKLANMDALNHYREIYSDWKERGKTFILNLYHWPLPLWLHDPIGVRKLGPDRAPSGWLDERSVVEFTKFAAFIAYHLDDLVDMWSTMNEPNVVYEQGYTRPQSGFPPGYLSHEAAGKAKLNLMQAHARAYDAIKEHSDKPVGLIYSFVWHDALNEEAEEIVKEIRRRHYDFVTGLHSGSSEFGEREDFKGKIDWIGVNYYTRVAYEMRNGRFMALPGYGYMCERSGYAKSGRPASDFGWETYPEGLENVLMDLKELYGLPMMVTENGMADMADRHRSYYLVSHLAAIHRAMEKGADVRGYLHWSLTDNYEWAQGFRMRFGLVMVDFETKKRYIRPSALVFREIATQKEIPEELSHLANLELVTKK

SEQ ID NO: 251 - DNA, 1455 bp, Unknown
  misc_feature: Thermococcus AEPII1a DNA
atgaagttcccatctaactttctttttggctactcctggtcgggcttccagtttgaaatgggtttacctgggagtgaagttgagagcgactggtgggcatgggtccacgataaggagaacatcttctcgggcctagttagcggtgacctaccagagaacgggcctgcttactggcacctctacaagaaagaccacgacatagctgaaagccttggcatggacgcgataagaggcggaatcgagtgggcgaggatcttcccaaaacccacctttgacgtgaaggttgacgtggaaaaggacgaaaacgggaacataatctccattgacgtcccggagagcgcgatagaggagctagaaaagcttgccaacatggatgccctcaaccactaccgcgaaatctactcggactggaaggagaggggcaagaccttcatattgaacctctatcactggccccttcccctctggctccacgacccgataggcgttagaaagctcggccctgatagagctccctcgggctggctggacgagaggagcgtggtggagttcaccaagttcgctgcattcatcgcctaccacttggatgacctcgttgacatgtggagcacgatgaacgagccgaatgtggtttacgagcagggttacacgaggcctcagtcgggctttccaccgggttatctcagccacgaggccgctggaaaggcgaagctcaacctcatgcaggctcacgctagagcttacgatgcgataaaagagcactcggacaagccagttggagttatctacgcatataagtggattgatgcggaggatgaagctgcagaggaatccgttctggaactccgcaggagggattacgacttcgttgatggtctctactcaggcaagtccctgactgcaggtgagagggaggacttcaaaggcagggtcgactgggttggcgtcaactactactcccgcctgctctttggaaaggccggagattcagtgagattacttgagggctacggttttgtctccccgaggggtggctacgccaaatcgggaaggcctgcgagcgattttggctgggagatttatcctgagggcctcgaaaagctcctggttgagctgagtggcaggtacgagcttccgctcttcataacggagaatggtatggctgatgctgtcgataggtacaggccttactacctcgtgagccacctcgcggctatccacagggcgatggagaagggtgccgacattagggggtacctccactggtctctgaccgacaactacgagtgggcgcagggcttcagaatgcgctttgggctggtgatggtggacttcgagactaagaagcgctacttgaggccgagcgcactcgtcttcagggaaatagccacgcggaaggaaatacccgaagagcttgaacaccttgccgatgtggatgcaatcattgctcggtga

SEQ ID NO: 252 - protein, 484 aa, Unknown
  DOMAIN (1)...(484): Thermococcus AEPII1a protein
  DOMAIN (1)...(468): Glycosyl hydrolase family 1
  SITE (7)...(21): Glycosyl hydrolases family 1 N-terminal signature. Prosite id = PS00653
  SITE (385)...(393): Glycosyl hydrolases family 1 active site. Prosite id = PS00572
MKFPSNFLFGYSWSGFQFEMGLPGSEVESDWWAWVHDKENIFSGLVSGDLPENGPAYWHLYKKDHDIAESLGMDAIRGGIEWARIFPKPTFDVKVDVEKDENGNIISIDVPESAIEELEKLANMDALNHYREIYSDWKERGKTFILNLYHWPLPLWLHDPIGVRKLGPDRAPSGWLDERSVVEFTKFAAFIAYHLDDLVDMWSTMNEPNVVYEQGYTRPQSGFPPGYLSHEAAGKAKLNLMQAHARAYDAIKEHSDKPVGVIYAYKWIDAEDEAAEESVLELRRRDYDFVDGLYSGKSLTAGEREDFKGRVDWVGVNYYSRLLFGKAGDSVRLLEGYGFVSPRGGYAKSGRPASDFGWEIYPEGLEKLLVELSGRYELPLFITENGMADAVDRYRPYYLVSHLAAIHRAMEKGADIRGYLHWSLTDNYEWAQGFRMRFGLVMVDFETKKRYLRPSALVFREIATRKEIPEELEHLADVDAIIAR

SEQ ID NO: 253 - DNA, 2166 bp, Thermotoga maritima
  misc_feature: Thermotoga maritima MSB8 DNA
atggaaaggatcgatgaaattctctctcagttaactacagaggaaaaggtgaagctcgttgtgggggttggtcttccaggactttttgggaacccacattccagagtggcgggtgcggctggagaaacacatcccgttccaagacttggaattcctgcgtttgtcctggcagatggtcccgcaggactcagaataaatcccacaagggaaaacgatgaaaacacttactacacgacggcatttcccgttgaaatcatgctcgcttctacctggaacagagaccttctggaagaagtgggaaaagccatgggagaagaagttagggaatacggtgtcgatgtgcttcttgcacctgcgatgaacattcacagaaaccctctttgtggaaggaatttcgagtactactcagaagatcctgtcctttccggtgaaatggcttcagcctttgtcaagggagttcaatctcaaggggtgggagcctgcataaaacactttgtcgcgaacaaccaggaaacgaacaggatggtagtggacacgatcgtgtccgagcgagccctcagagaaatatatctgaaaggttttgaaattgctgtcaagaaagcaagaccctggaccgtgatgagcgcttacaacaaactgaatggaaaatactgttcacagaacgaatggcttttgaagaaggttctcagggaagaatggggatttggcggtttcgtgatgagcgactggtacgcgggagacaaccctgtagaacagctcaaggccggaaacgatatgatcatgcctgggaaagcgtatcaggtgaacacagaaagaagagatgaaatagaagaaatcatggaggcgttgaaggagggaaaattgagtgaggaggttctcgatgagtgtgtgagaaacattctcaaagttcttgtgaacgcgccttccttcaaagggtacaggtactcaaacaagccggatctcgaatctcacgcggaagtcgcctacgaagcaggtgcggagggtgttgtccttcttgagaacaacggtgttcttccgttcgatgaaaatacccatgtcgccgtctttggcaccggtcaaatcgaaacaataaagggaggaacgggaagtggagacacccatccgagatacacgatctctatccttgaaggcataaaagaaagaaacatgaagttcgacgaagaactcgcttccacttatgaggagtacataaaaaagatgagagaaacagaggaatataaacccagaaccgactcttggggaacggtcataaaaccgaaactcccagagaatttcctctcagaaaaagagataaagaaacctccaaagaaaaacgatgttgcagttgttgtgatcagtaggatctccggtgagggatacgacagaaagccggtgaaaggtgacttctacctctccgatgacgagctggaactcataaaaaccgtctcgaaagaattccacgatcagggtaagaaagttgtggttcttctgaacatcggaagtcccatcgaagtcgcaagctggagagaccttgtggatggaattcttctcgtctggcaggcgggacaggagatgggaagaatagtggccgatgttcttgtgggaaagattaatccctccggaaaacttccaacgaccttcccgaaggattactcggacgttccatcctggacgttcccaggagagccaaaggacaatccgcaaagagtggtgtacgaggaagacatctacgtgggatacaggtactacgacaccttcggtgtggaacctgcctacgaattcggctacggcctctcttacacaaagtttgaatacaaagatttaaaaatcgctatcgacggtgagacgctcagagtgtcgtacacgatcacaaacactggggacagagctggaaaggaagtctcacaggtctacatcaaagctccaaaaggaaaaatagacaaacccttccaggagctgaaagcgtttcacaaaacaaaacttttgaacccgggtgaatcagaagaaatctccttggaaattcctctcagagatcttgcgagtttcgatgggaaagaatgggttgtcgagtcaggagaatacgaggtcagggtcggtgcatcttcgagggatataaggttgagagatatttttctggttgagggagagaagagattcaaaccatga

SEQ ID NO: 254 - protein, 721 aa, Thermotoga maritima
  DOMAIN (1)...(721): Thermotoga maritima MSB8 protein
  DOMAIN (43)...(262): Glycosyl hydrolase family 3 N terminal domain
  DOMAIN (336)...(602): Glycosyl hydrolase family 3 C terminal domain
  SITE (231)...(248): Glycosyl hydrolases family 3 active site. Prosite id = PS00775
MERIDEILSQLTTEEKVKLVVGVGLPGLFGNPHSRVAGAAGETHPVPRLGIPAFVLADGPAGLRINPTRENDENTYYTTAFPVEIMLASTWNRDLLEEVGKAMGEEVREYGVDVLLAPAMNIHRNPLCGRNFEYYSEDPVLSGEMASAFVKGVQSQGVGACIKHFVANNQETNRMVVDTIVSERALREIYLKGFEIAVKKARPWTVMSAYNKLNGKYCSQNEWLLKKVLREEWGFGGFVMSDWYAGDNPVEQLKAGNDMIMPGKAYQVNTERRDEIEEIMEALKEGKLSEEVLDECVRNILKVLVNAPSFKGYRYSNKPDLESHAEVAYEAGAEGVVLLENNGVLPFDENTHVAVFGTGQIETIKGGTGSGDTHPRYTISILEGIKERNMKFDEELASTYEEYIKKMRETEEYKPRTDSWGTVIKPKLPENFLSEKEIKKPPKKNDVAVVVISRISGEGYDRKPVKGDFYLSDDELELIKTVSKEFHDQGKKVVVLLNIGSPIEVASWRDLVDGILLVWQAGQEMGRIVADVLVGKINPSGKLPTTFPKDYSDVPSWTFPGEPKDNPQRVVYEEDIYVGYRYYDTFGVEPAYEFGYGLSYTKFEYKDLKIAIDGETLRVSYTITNTGDRAGKEVSQVYIKAPKGKIDKPFQELKAFHKTKLLNPGESEEISLEIPLRDLASFDGKEWVVESGEYEVRVGASSRDIRLRDIFLVEGEKRFKP

SEQ ID NO: 255 - DNA, 1224 bp, Unknown
  Obtained from environmental sample
atgaaagtattccgaaattcgatcatccgtaagtcggtggtattgttctgtgctgttctatggatcttgccagccggattgtctctggcggccaacaagccgtttccccagcatacgtcttatacgagcggttcgattaaaccaaacaatgtaacgcagtcagcgatggacaatgcggtcaagagcaaatggaacagctggaaagggtctttcttgaagccggctgcgacaggacaatattacgtaaaatacaattcggcgggcgagacggtgtctgaggctcatggctacggaatgattttcaccgttctgatggcgggttacgacagtaacgcacagtcgtatttcgacggactttatcgctactataaggcgcatccgagtaataacaatccgtatctgatggcttggaaacagaacagcagctttcagaatatagagggagccaattcggcaacggatggcgatatggacattgcttacgcactcctgcttgcggacaagcagtggggaagcagtggatcgattaattatctccaggcagctaaggatatgatcaatgcgatcatgagtaatgacgttaatcagtcgcagtggacgctgcgcttaggcgattgggcaaccagtggcatcttcgataccgccacgcggccatcggatttcatgctgaaccatatgaaggcattccgtacggctaccggcgatgcccgttgggataacgtcatcaacaaaacctatacgatcatcaactccatctataacggttacagctccaataccggtttgcttccggatttcgttgtcatgtcgggcggcaattatcagcctgcggcagcggaattcctggagggggcgaacgacggaaaatactattacaactcggccaggactccttggcggattacgaccgactatctgatgaccggcgatacgcgcgcgctgaatcaattgaacaaaatgaacacgttcattaagtcggctgcgaacagcaatcctgccaatatcaaggcagggtataatctgaacggaactgcgctggtgacttataacagcggagcgttctatgcaccgttcggcgtaagcgcgatgacgtcgtccagccaccagagctggctgaattcggtatggaattatacggcgaacgcatctgcagagggttattatgaggagagcatcaagctgttctcgatgatcgtcatgtcgggaaattggtggacatattaa

SEQ ID NO: 256 - protein, 407 aa, Unknown
  Obtained from environmental sample
  SIGNAL (1)...(30)
  DOMAIN (33)...(402): Glycosyl hydrolases family 8
  SITE (50)...(53): N-glycosylation site. Prosite id = PS00001
  SITE (65)...(68): N-glycosylation site. Prosite id = PS00001
  SITE (142)...(145): N-glycosylation site. Prosite id = PS00001
  SITE (154)...(172): Glycosyl hydrolases family 8 signature. Prosite id = PS00812
  SITE (246)...(249): N-glycosylation site. Prosite id = PS00001
  SITE (347)...(350): N-glycosylation site. Prosite id = PS00001
  SITE (382)...(385): N-glycosylation site. Prosite id = PS00001
  SITE (386)...(389): N-glycosylation site. Prosite id = PS00001
MKVFRNSIIRKSVVLFCAVLWILPAGLSLAANKPFPQHTSYTSGSIKPNNVTQSAMDNAVKSKWNSWKGSFLKPAATGQYYVKYNSAGETVSEAHGYGMIFTVLMAGYDSNAQSYFDGLYRYYKAHPSNNNPYLMAWKQNSSFQNIEGANSATDGDMDIAYALLLADKQWGSSGSINYLQAAKDMINAIMSNDVNQSQWTLRLGDWATSGIFDTATRPSDFMLNHMKAFRTATGDARWDNVINKTYTIINSIYNGYSSNTGLLPDFVVMSGGNYQPAAAEFLEGANDGKYYYNSARTPWRITTDYLMTGDTRALNQLNKMNTFIKSAANSNPANIKAGYNLNGTALVTYNSGAFYAPFGVSAMTSSSHQSWLNSVWNYTANASAEGYYEESIKLFSMIVMSGNWWTY

SEQ ID NO: 257 - DNA, 1500 bp, Unknown
  Obtained from environmental sample
atgaaacgttcagtctctatctttatcgcatgtttagtaatgacagtattaacaattagcggtgtcgcggcaccagaagcatctgcagcaggggcgaaaacgcctgtagcccttaatggccagcttagcattaaaggtactcagctagtcaatcaaaacggaaaatcggtgcagctgaaggggatcagctcacacggtttgcagtggttcggcgattatgtcaataaagactctttaaaatggctaagagacgattggggaattaccgtcttccgagcggcaatgtacacggctgaaggcggttatatagagaatccgtctgtgaaaaataaagtcaaagaagctgttgaagcggcaaaagagctcgggatatatgtcatcattgactggcatattttaaatgacggcaatccaaatcaaaataaagagaaggcgaaggaattctttaaggaaatgtcgagcctttacggaagcacaccaaacgttatttatgaaattgctaatgaaccgaacggtgatgtaaattggaagcgcgatatcaaaccgtatgcggaggaagtgatttccgttatccgtaaaaatgacccggataacatcattattaccggaactggcacttggagtcaggatgtcaatgatgctgctgatgatcagcttaaggatgcaaacgtcatgtacgcgcttcatttttatgcaggtacacacggccagtatttaagggataaagccgattatgcgctcagcaaaggagcgccgatttttgtaacggaatgggggacgagtgacgcttccggaaatggcggggtcttccttgaccagtcgagggaatggctgaattatctcgacaacaagaaaatcagctgggtaaactggaacctttctgataagcaggaatcttcctcagctttaaagccgggggcatctaaaacaggcggctggccgttatcagatttatccgcttcagggacatttgtaagggaaaagatccgtggctcccaacattcgactgaagacagatctgagacaccaaagcaagataaacccgtacaggaaaacagcctatctgtgcaatacagaacaggggatggaagtgtgaacagcaaccaaatccgtcctcagatccatgtgaaaaacaacagcaagaccaccgttaatttaaaaaatgtaactgtccgctactggtataacacgaaaaacaaaggccaaaacttcgactgtgactacgcgaagatcggatgcagcaatgtgacgcacaagtttgtgacattacaaaaacctgtaaaaggtgcagatgcctatctggaacttgggtttaaaaacgggacactgtcaccgggagcaaacactggagaaatccaaattcgtcttcacaatgaggattggggcaattattcacaaatcggggattattctttttctcagtcaaatacgtttaaagatacaaaaaaaatcacattatataataacggaaaactaatttggggaactgaacccaaatag

SEQ ID NO: 258 - protein, 499 aa, Unknown
  Obtained from environmental sample
  SIGNAL (1)...(29)
  DOMAIN (47)...(301): Cellulase (glycosyl hydrolase family 5)
  DOMAIN (356)...(437): Cellulose binding domain
  SITE (164)...(173): Glycosyl hydrolases family 5 signature. Prosite id = PS00659
  SITE (296)...(299): N-glycosylation site. Prosite id = PS00001
  SITE (383)...(386): N-glycosylation site. Prosite id = PS00001
  SITE (393)...(396): N-glycosylation site. Prosite id = PS00001
  SITE (421)...(424): N-glycosylation site. Prosite id = PS00001
  SITE (446)...(449): N-glycosylation site. Prosite id = PS00001
  SITE (470)...(473): N-glycosylation site. Prosite id = PS00001
MKRSVSIFIACLVMTVLTISGVAAPEASAAGAKTPVALNGQLSIKGTQLVNQNGKSVQLKGISSHGLQWFGDYVNKDSLKWLRDDWGITVFRAAMYTAEGGYIENPSVKNKVKEAVEAAKELGIYVIIDWHILNDGNPNQNKEKAKEFFKEMSSLYGSTPNVIYEIANEPNGDVNWKRDIKPYAEEVISVIRKNDPDNIIITGTGTWSQDVNDAADDQLKDANVMYALHFYAGTHGQYLRDKADYALSKGAPIFVTEWGTSDASGNGGVFLDQSREWLNYLDNKKISWVNWNLSDKQESSSALKPGASKTGGWPLSDLSASGTFVREKIRGSQHSTEDRSETPKQDKPVQENSLSVQYRTGDGSVNSNQIRPQIHVKNNSKTTVNLKNVTVRYWYNTKNKGQNFDCDYAKIGCSNVTHKFVTLQKPVKGADAYLELGFKNGTLSPGANTGEIQIRLHNEDWGNYSQIGDYSFSQSNTFKDTKKITLYNNGKLIWGTEPK

SEQ ID NO: 259 - DNA, 942 bp, Unknown
  Obtained from environmental sample
atgctttcttttgcaaccgcttgtgctgaagctcaatcggccgaaaatgaagtagatacatttgttggtaaacatggatggttatcagtgaaagggacttccttgatagatgagaatggtgaaactttagtaatgaaaggtgttagtttagggtggcacaactggtggtctcaattttataatgagtctacagtaacatggttgcagaacgattgggactgcaaccttgttcgtgctgcaattggagtagagccgaatggagcatatatagacaattcggtcttagctaacaactgtcttgacaacgtcgttgatgctgctatcaaaaatggaatgtatgtaatcatcgattggcatagccataatgtgagggcggaggaagcaaaagcattttttacacgtgtggcgaataaatataaggattatccgaatattatctatgaaatattcaatgaacccgaacgcatatcttgggaagaggtaaaatcatattccgaagagttaattaaaacgatcagggctattgataagaaaaatgttatccttgttggaactccgcattgggatcaggacatacatttagctgcggataaccctattaaaggatatgataacatcatgtatactttacatttttatgcagcaacccataaaaaagaacttcgagatcgtgccgattatgctttgaaaaaaggaatcccaatattcgtatccgaatgtgctggtatggaagctaccggagacggacctattgaccacaatgaatggaatacttgggtagagtggatggctaaaaacaatatcagctgggtagcatggtctatatctagtaagaatgaaacatgttcgatgataaaagacgattcatctcccattagtaattgggccacggacgatttgaaagaatggggtgtacttgttaaaagtctattgaagaaataa

SEQ ID NO: 260 - protein, 313 aa, Unknown
  Obtained from environmental sample
  DOMAIN (33)...(283): Cellulase (glycosyl hydrolase family 5)
  SITE (61)...(64): N-glycosylation site. Prosite id = PS00001
  SITE (271)...(274): N-glycosylation site. Prosite id = PS00001
  SITE (283)...(286): N-glycosylation site. Prosite id = PS00001
MLSFATACAEAQSAENEVDTFVGKHGWLSVKGTSLIDENGETLVMKGVSLGWHNWWSQFYNESTVTWLQNDWDCNLVRAAIGVEPNGAYIDNSVLANNCLDNVVDAAIKNGMYVIIDWHSHNVRAEEAKAFFTRVANKYKDYPNIIYEIFNEPERISWEEVKSYSEELIKTIRAIDKKNVILVGTPHWDQDIHLAADNPIKGYDNIMYTLHFYAATHKKELRDRADYALKKGIPIFVSECAGMEATGDGPIDHNEWNTWVEWMAKNNISWVAWSISSKNETCSMIKDDSSPISNWATDDLKEWGVLVKSLLKK

SEQ ID NO: 261 - DNA, 960 bp, Pyrococcus furiosus
  misc_feature: Pyrococcus furiosus VC1 DNA
atgagcaagaaaaagttcgtcatcgtatctatcttaacaatccttttagtacaggcaatatattttgtagaaaagtatcatacctctgaggacaagtcaacttcaaatacctcatctacaccaccccaaacaacactttccactaccaaggttctcaagattagataccctgatgacggtgagtggccaggagctcctattgataaggatggtgatgggaacccagaattctacattgaaataaacctatggaacattcttaatgctactggatttgctgagatgacgtacaatttaaccagcggcgtccttcactacgtccaacaacttgacaacattgtcttgagggatagaagtaattgggtgcatggataccccgaaatattctatggaaacaagccatggaatgcaaactacgcaactgatggcccaataccattacccagtaaagtttcaaacctaacagacttctatctaacaatctcctataaacttgagcccaagaacggcctgccaattaacttcgcaatagaatcctggttaacgagagaagcttggagaacaacaggaattaacagcgatgagcaagaagtaatgatatggatttactatgacggattacaaccggctggctccaaagttaaggagattgtagtcccaataatagttaacggaacaccagtaaatgctacatttgaagtatggaaggcaaacattggttgggagtatgttgcatttagaataaagaccccaatcaaagagggaacagtgacaattccatacggagcatttataagtgttgcagccaacatttcaagcttaccaaattacacagaactttacttagaggacgtggagattggaactgagtttggaacgccaagcactacctccgcccacctagagtggtggatcacaaacataacactaactcctctagatagacctcttatttcctaa

SEQ ID NO: 262 - protein, 319 aa, Pyrococcus furiosus
  DOMAIN (1)...(319): Pyrococcus furiosus VC1 protein
  SIGNAL (1)...(19)
  DOMAIN (143)...(311): Glycosyl hydrolase family 12
  SITE (36)...(39): N-glycosylation site. Prosite id = PS00001
  SITE (89)...(92): N-glycosylation site. Prosite id = PS00001
  SITE (99)...(102): N-glycosylation site. Prosite id = PS00001
  SITE (155)...(158): N-glycosylation site. Prosite id = PS00001
  SITE (232)...(235): N-glycosylation site. Prosite id = PS00001
  SITE (274)...(277): N-glycosylation site. Prosite id = PS00001
  SITE (280)...(283): N-glycosylation site. Prosite id = PS00001
  SITE (311)...(314): N-glycosylation site. Prosite id = PS00001
MSKKKFVIVSILTILLVQAIYFVEKYHTSEDKSTSNTSSTPPQTTLSTTKVLKIRYPDDGEWPGAPIDKDGDGNPEFYIEINLWNILNATGFAEMTYNLTSGVLHYVQQLDNIVLRDRSNWVHGYPEIFYGNKPWNANYATDGPIPLPSKVSNLTDFYLTISYKLEPKNGLPINFAIESWLTREAWRTTGINSDEQEVMIWIYYDGLQPAGSKVKEIVVPIIVNGTPVNATFEVWKANIGWEYVAFRIKTPIKEGTVTIPYGAFISVAANISSLPNYTELYLEDVEIGTEFGTPSTTSAHLEWWITNITLTPLDRPLIS

SEQ ID NO: 263 - DNA, 1419 bp, Pyrococcus furiosus
  misc_feature: Pyrococcus furiosus VC1 DNA
atgaagttcccaaaaaacttcatgtttggatattcttggtctggtttccagtttgagatgggactgccaggaagtgaagtggaaagcgactggtgggtgtgggttcacgacaaggagaacatagcatcaggtctagtaagtggagatctaccagagaacggcccagcatattggcacctctataagcaagatcatgacattgcagaaaagctaggaatggattgtattagaggtggcattgagtgggcaagaatttttccaaagccaacatttgacgttaaagttgatgtggaaaaggatgaagaaggcaacataatttccgtagacgttccagagagtacaataaaagagctagagaaaattgccaacatggaggcccttgaacattatcgcaagatttactcagactggaaggagaggggcaaaaccttcatattaaacctctaccactggcctcttccattatggattcatgacccaattgcagtaaggaaacttggcccggatagggctcctgcaggatggttagatgagaagacagtggtagagtttgtgaagtttgccgccttcgttgcttatcaccttgatgacctcgttgacatgtggagcacaatgaacgaaccaaacgtagtctacaatcaaggttacattaatctacgttcaggatttccaccaggatatctaagctttgaagcagcagaaaaggcaaaattcaacttaattcaggctcacatcggagcatatgatgccataaaagagtattcagaaaaatccgtgggagtgatatacgcctttgcttggcacgatcctctagcggaggagtataaggatgaagtagaggaaatcagaaagaaagactatgagtttgtaacaattctacactcaaaaggaaagctagactggatcggcgtaaactactactccaggctggtatatggagccaaagatggacacctagttcctttacctggatatggatttatgagtgagagaggaggatttgcaaagtcaggaagacctgctagtgactttggatgggaaatgtacccagagggccttgagaaccttcttaagtatttaaacaatgcctacgagctaccaatgataattacagagaacggtatggccgatgcagcagatagatacaggccacactatctcgtaagccatctaaaggcagtttacaatgctatgaaagaaggtgctgatgttagagggtatctccactggtctctaacagacaactacgaatgggcccaagggttcaggatgagatttggattggtttacgtggatttcgagacaaagaagagatatttaaggccaagcgccctggtattcagagaaatagccactcaaaaagaaattccagaagaattagctcacctcgcagacctcaaatttgttacaagaaagtag

SEQ ID NO: 264 - protein, 472 aa, Pyrococcus furiosus
  DOMAIN (1)...(472): Pyrococcus furiosus VC1 protein
  DOMAIN (1)...(456): Glycosyl hydrolase family 1
  SITE (7)...(21): Glycosyl hydrolases family 1 N-terminal signature. Prosite id = PS00653
  SITE (373)...(381): Glycosyl hydrolases family 1 active site. Prosite id = PS00572
MKFPKNFMFGYSWSGFQFEMGLPGSEVESDWWVWVHDKENIASGLVSGDLPENGPAYWHLYKQDHDIAEKLGMDCIRGGIEWARIFPKPTFDVKVDVEKDEEGNIISVDVPESTIKELEKIANMEALEHYRKIYSDWKERGKTFILNLYHWPLPLWIHDPIAVRKLGPDRAPAGWLDEKTVVEFVKFAAFVAYHLDDLVDMWSTMNEPNVVYNQGYINLRSGFPPGYLSFEAAEKAKFNLIQAHIGAYDAIKEYSEKSVGVIYAFAWHDPLAEEYKDEVEEIRKKDYEFVTILHSKGKLDWIGVNYYSRLVYGAKDGHLVPLPGYGFMSERGGFAKSGRPASDFGWEMYPEGLENLLKYLNNAYELPMIITENGMADAADRYRPHYLVSHLKAVYNAMKEGADVRGYLHWSLTDNYEWAQGFRMRFGLVYVDFETKKRYLRPSALVFREIATQKEIPEELAHLADLKFVTRK

SEQ ID NO: 265 - DNA, 1434 bp, Unknown
  misc_feature: Bacterial DNA
atgaccgcgtccgaaacccggccgctcacggccacccgctcgttcccggccgacttcctctggggcgcggccaccgccgcgtaccagatcgagggagcggcggccgaggacggccgtaccccgtccatctgggataccttctcgcacacccccggcaaggtcttcgagggccacaccggtgacgtggcggtggaccactaccaccggttccgcgaggacgtcgcgatcatgtcggaactcggcctgaacgcctaccggttctccgtctcctggtcccgggtgcagcccaccgggcggggtccggccgtccagaaggggctggacttctaccgggcgctcgtcgacgagctgctcgccgccgggatcgagccggcgctcaccctctaccactgggacctgccgcaggagctggaggacgccgggggctggccggagcgggcgaccgcggagcgcttcgccgagtacgcggggatcgtcgcgggcgccctcggggaccgggtgacccgctggaccaccctcaacgagccctggtgcagcgccttcctggggtacggctccggggtgcacgccccgggccgcacggacccggtcgcctcgctgcgcgccgcccaccacctcaacctcgggcacggtctcgcggtgcaggcgctgcgggccgcgctgccggccgaccggcagctcgcggtctcgctcaacctgcacgaggtgcggccgctgacccggtccgccgaggacctcgacgcggcccgccgcatcgacgccgtcggcaaccggatctggctcgggccgatgctggagggcgcctaccccgaggacctgatcctcgacacggcgcagctcacggactggtccttcgtcaaggacggcgacccggcggcgatcgcgcagccgctggacctgctcgcgatcaactactacaccccgacggtcgtctcgcacgttccggagggtgcggagaagccgcaggacgacggtcacggcaacagcgaccactcgccgtggcccggggcggacatggtcgccttccaccgggcgccgggcgagcggacggcgatgggctggccggtcgacgcgagcgccctgtacgacctgctgacccgggtgtcggacgcgtacccgcaactcccgctggtcatcagcgagaacggggcggcgtacgaggacgtggtggcgccggacggttcggtgcacgacccggagcgggcggcgtacgtgcacgcgcatctggaggccgtgcaccgcgcgctcgcggacggcgtggacgtgcgcggctatttcctgtggtcgctgctcgacaacttcgagtgggcgtacggctatgcgaagcgcttcggcgcggtccgggtggactacgacaccctggagcggacgccgaagtccagcgcccgctggtacgcgcgggtggcgcggtcgggcgaactgctggcgccctga

SEQ ID NO: 266 - protein, 477 aa, Unknown
  DOMAIN (1)...(477): Bacterial protein
  DOMAIN (11)...(474): Glycosyl hydrolase family 1
  SITE (19)...(33): Glycosyl hydrolases family 1 N-terminal signature. Prosite id = PS00653
  SITE (382)...(390): Glycosyl hydrolases family 1 active site. Prosite id = PS00572
MTASETRPLTATRSFPADFLWGAATAAYQIEGAAAEDGRTPSIWDTFSHTPGKVFEGHTGDVAVDHYHRFREDVAIMSELGLNAYRFSVSWSRVQPTGRGPAVQKGLDFYRALVDELLAAGIEPALTLYHWDLPQELEDAGGWPERATAERFAEYAGIVAGALGDRVTRWTTLNEPWCSAFLGYGSGVHAPGRTDPVASLRAAHHLNLGHGLAVQALRAALPADRQLAVSLNLHEVRPLTRSAEDLDAARRIDAVGNRIWLGPMLEGAYPEDLILDTAQLTDWSFVKDGDPAAIAQPLDLLAINYYTPTVVSHVPEGAEKPQDDGHGNSDHSPWPGADMVAFHRAPGERTAMGWPVDASALYDLLTRVSDAYPQLPLVISENGAAYEDVVAPDGSVHDPERAAYVHAHLEAVHRALADGVDVRGYFLWSLLDNFEWAYGYAKRFGAVRVDYDTLERTPKSSARWYARVARSGELLAP

SEQ ID NO: 267 - DNA, 1287 bp, Unknown
  misc_feature: Bacterial DNA
atgaacccacgcagcctccggcgccgtacgaccgccgccctcgcggcgctcgcggcctgtgccgccctcctcgcgacgcaggcgcaggcgcaggcgcaggccgcacccgtcgcggacgcgctcacccccgccacgaggttctacgtggacccgaacagcaaggccgccaagcaggcgctcaccgacctccggaacggagacttcgcgaacgccgtgaacatggccaggctcgcgagctggcctcaggccgagtggttcaccgagggcacacccgacgaggtccgggccaaggtgaggagcctcgtccgcgaggcccggctggtgaaccggacccccgtcctggtcgcctacaacgtcccgggccgcgactgttcgcagtactccagcggcggcgccgcgtcctccgccgcctaccggaagtggatcgacgccttcgccgccggcatcggcgacagcaaagccgtcgtcgtggtcgagcccgacggcctggccctcctcccgagcgactgcggaccgggggtggacccgaccggcgaactcacggcgacccgcgtcgccgacctcacgtacgccgtcaggaccctcaaggccaaggcccgcaccacggtctacctcgacgccggcaacgtccagtggcggcccgtcggcgagatggcgcggcgactgctcgacgccggcgtccagcacagcgacggcttcgccctcaacgtctccaacacccaccccaccgaccacaacacgcggtacggcacctggatctcccggtgcatgtggtacgccaccgaggggcccgagtacgcccgcggccacaccgactggtgcgccacccagtactactcgcccgccgcgcccaacgacggcgcccccggcaacgcggtcgaccccgccgaccccgccacctggcgctggaccgacgcctggttcgaccagaacgcgggcaccccgccgaacgacgccctgcaccacttcgtcatcgacaccagccgcaacggtctgggcgcctggaccccggagcccggcaagtactccggcgacccggagatctggtgcaacgcacccggccgcggcctcggcccccgcccgaccgccgacaccggtgtcccgctcgtcgacgcctacctgtgggtcaagatccccggcgagtccgacggcagctgcacgcgcaacaccggcggcacgatcgaccccgagtacggcatcgtcgacccacccgccggcgcctggtggcccgcccaggcccacaccctggcccgcaacgcggcaccacgactgaccttcaaccactga

SEQ ID NO: 268 - protein, 428 aa, Unknown
  DOMAIN (1)...(428): Bacterial protein
  SIGNAL (1)...(30)
  DOMAIN (49)...(396): Glycosyl hydrolases family 6
  SITE (239)...(242): N-glycosylation site. Prosite id = PS00001
MNPRSLRRRTTAALAALAACAALLATQAQAQAQAAPVADALTPATRFYVDPNSKAAKQALTDLRNGDFANAVNMARLASWPQAEWFTEGTPDEVRAKVRSLVREARLVNRTPVLVAYNVPGRDCSQYSSGGAASSAAYRKWIDAFAAGIGDSKAVVVVEPDGLALLPSDCGPGVDPTGELTATRVADLTYAVRTLKAKARTTVYLDAGNVQWRPVGEMARRLLDAGVQHSDGFALNVSNTHPTDHNTRYGTWISRCMWYATEGPEYARGHTDWCATQYYSPAAPNDGAPGNAVDPADPATWRWTDAWFDQNAGTPPNDALHHFVIDTSRNGLGAWTPEPGKYSGDPEIWCNAPGRGLGPRPTADTGVPLVDAYLWVKIPGESDGSCTRNTGGTIDPEYGIVDPPAGAWWPAQAHTLARNAAPRLTFNH

SEQ ID NO: 269 - DNA, 966 bp, Unknown
  misc_feature: Bacterial DNA
atgcgccgcagaatccgcgccctcgtcgcagccctctccgcactgccgttggcgctcgtcgtcgccccgtccgcccacgcggcggatcccaccaccatgaccagcgggttctacacggaccccgactccagcgcgaagaagtgggtcgccgccaaccccggcgacggccgggcccccgcgatcagcacctccctcgccaacacccccatggcccgctggttcggcgcctggagcggcacgatcggcaccgcggcgggcgcgtacgtcggcgcggcggaccagcaggacaagctgcccatcctggtcgcgtacaacatctacctccgcgactcctgcggcgggcactccggcggcggggccccgtcggcctccgcgtacgcgacctggatcgcgcagttcgccggcgggatcgcgggccgcccggccgtcgtcctcctcgaacccgactccctcgcggactacggctgcctgaaccagacccagatccgcgaacgccagggcatgatcagcggcgcgctcgccgagttcaaccggcagtcccccaacacgtgggtctacctggacgccggcaaccccggctgggtgagcgcggcgacgatggcccagcgcctccacgaagccggcctccgccaggcacacggcttctccctcaacatctcgaactactacaccaccgaccagaacaccgcctacggcaacgcagtcaacagcgaactggccgcccgctacggctacaccaagccgttcgtcgtcgacaccagccgcaacggcaagggctccaacggcgagtggtgcaacgcggccggccgccgcatcggcacgcccacccggctgggcgggggcgccgagatgctgctgtggatcaaggccccgggcgagtccgacggcaactgcggcgtcgggaccggttccacggccggccagttcctcccggaggccgcctacaagatgatctacggctactga

SEQ ID NO: 270 - protein, 321 aa, Unknown
  DOMAIN (1)...(321): Bacterial protein
  SIGNAL (1)...(27)
  DOMAIN (39)...(311): Glycosyl hydrolases family 6
  SITE (145)...(154): Glycosyl hydrolases family 6 signature 2. Prosite id = PS00656
  SITE (160)...(163): N-glycosylation site. Prosite id = PS00001
  SITE (221)...(224): N-glycosylation site. Prosite id = PS00001
MRRRIRALVAALSALPLALVVAPSAHAADPTTMTSGFYTDPDSSAKKWVAANPGDGRAPAISTSLANTPMARWFGAWSGTIGTAAGAYVGAADQQDKLPILVAYNIYLRDSCGGHSGGGAPSASAYATWIAQFAGGIAGRPAVVLLEPDSLADYGCLNQTQIRERQGMISGALAEFNRQSPNTWVYLDAGNPGWVSAATMAQRLHEAGLRQAHGFSLNISNYYTTDQNTAYGNAVNSELAARYGYTKPFVVDTSRNGKGSNGEWCNAAGRRIGTPTRLGGGAEMLLWIKAPGESDGNCGVGTGSTAGQFLPEAAYKMIYGY

SEQ ID NO: 271 - DNA, 1404 bp, Unknown
  misc_feature: Bacterial DNA
atgaccgcgctcgacgcccgcaccgacaccacgaccgtcctccgtttccccgcgggcttccgctggggcaccgccacggccgcctaccagatcgagggggcggcgacggaggacggccgcaccccgtccatctgggacaccttcagccgcacgcccggcaaggtgcgcaacggcgacaccggtgacatcgccgccgaccactaccaccgggtcgacgaggacgtcgccctgatgcggcggctcggcgtgaccgactaccgcttctcgatcgcctggccccgggtgcagcccaccgggcgcggcccggccgtgcgcaagggcctggacttctaccggcggctggtcgaccgcctcctcgacgccggcatccgtcccgtggcgacgctctaccactgggacctgccgcaggagttggaggacgccgggggctggccgcagcgggagaccgcgtaccgcttcgcggagtacgcgggcatcatggcggacgccctcggcgaccgggtggcgacctggacgacgctcaacgagccctggtgcgcggccttcctcggctacggcaacggcgtgcacgcgccgggccgcaccagcgccgtcgcctcgctgcgggcggcccaccacctcaacctcgcgcacggcctcgcggcgcgcaccctgcgcgggcggctgcccggcgctgcggaggtgtcgctgaccctcaacctccatgcggtgcggccctgttcgcaggcgccggaggatctggacgcggcccgccggatcgacgcggtcggcaaccggatcttcctcgaccccgtcttccacggccggctcccggaagacctcgtgcgggacaccgccccggtcacggactggtccttcgtggccgacggagacctggcggcggcggccgcgccgatcgactcgctcggcatcaactactactccccgtccgtcgtcggcgccggcacgtcggagtcgccctcgccgtgggcgggcgcggagcggcacgtccggttcgagcccgcgccggggccgcggacggcgatggactggccggtggacgcggacggtctgtacgagctgctgacccggctgcgggacgagctccctgacgtaccgctggtgatcaccgagaacggggcggcgtacgacgactacgccgacccctccgggaacgtgaaggacccggagcgggtggcgtacctccacgcccacctggcggcggtgcaccgggcgctggcggacggcgccgacgtccgcgggtacttcctctggtcgctcctggacaacttcgagtgggcgtacggctacagcaagcgcttcgggatcgtgcacgtggacttcgcgacgcagcgccggacgctgaaggacagcgcccggtggtacgcggaggtcatcgcgcgcggcggtctggaaggggcctga

SEQ ID NO: 272 - protein, 467 aa, Unknown
  DOMAIN (1)...(467): Bacterial protein
  DOMAIN (12)...(464): Glycosyl hydrolase family 1
  SITE (20)...(34): Glycosyl hydrolases family 1 N-terminal signature. Prosite id = PS00653
  SITE (372)...(380): Glycosyl hydrolases family 1 active site. Prosite id = PS00572
MTALDARTDTTTVLRFPAGFRWGTATAAYQIEGAATEDGRTPSIWDTFSRTPGKVRNGDTGDIAADHYHRVDEDVALMRRLGVTDYRFSIAWPRVQPTGRGPAVRKGLDFYRRLVDRLLDAGIRPVATLYHWDLPQELEDAGGWPQRETAYRFAEYAGIMADALGDRVATWTTLNEPWCAAFLGYGNGVHAPGRTSAVASLRAAHHLNLAHGLAARTLRGRLPGAAEVSLTLNLHAVRPCSQAPEDLDAARRIDAVGNRIFLDPVFHGRLPEDLVRDTAPVTDWSFVADGDLAAAAAPIDSLGINYYSPSVVGAGTSESPSPWAGAERHVRFEPAPGPRTAMDWPVDADGLYELLTRLRDELPDVPLVITENGAAYDDYADPSGNVKDPERVAYLHAHLAAVHRALADGADVRGYFLWSLLDNFEWAYGYSKRFGIVHVDFATQRRTLKDSARWYAEVIARGGLEGA

SEQ ID NO: 273 - DNA, 1410 bp, Unknown
  Obtained from environmental sample
atggacgcgggggatatgaacatgaagtttgaaaatcgaatcggacgattcacccgatggtgctcgctcgtggcgatcgtcggcgtcgcgccggcgttcgccgacgtggcgcccttgtcggtgagcggcaaccagatccgcgcgggcgggcaacccgcgagcttcgcgggcaacagtctcttctggagcaacacgggctggggcggcgagaagtactacaacgcgaacgtggtccggtggctcaagacggactggaagtcgacgatcgtgcgcgcggcgatgggcgtcgacgaccagggcgggttcctgcaggacccgaccggcaatcgcaatcgcgtgaaggccgtggtcgacgcggcgatcgcgaacgacctgtacgtgatcatcgactggcactcgcaccacgcggagaactaccgcagccagtcgatcgcgttcttccaggagatggcgcgcacgtacggtcatcgcaatcacgtgatctacgagatctacaacgagccgctgcaggtgtcgtggagcgggacgatcaagccgtatgcgcaggccgtgatcagcgcgatccgcgcgatcgatcccgacaacctgatcgtggtcggcacgccgacgtggtcgcaggacgtggacgtcgcggcggcggatccgatcgccggcacgaacatcgcgtacacgctgcacttctacgccggcacgcacgggcagtacctgcgcgacaaggcgcagactgcgctgaatcgcggcgtggcgctgttcgtgacggagtggggctcggtgaacgcgaacggcgatggcgccgtcgcgaccgcggagaccaacaactggatgacgttcctcaagtcgcgcggcatcagtcacgcgaactgggcgacgaacgacaaggcggaaggcgcttccgcgctcgtgccgggcgcgagcacctcgggcaactggacggcaaaccagctgacggcgtcgggcgcgctcgcgaagcagatcatctcggggtggggcggcacgacgccgaatccgccgggtaacgtcatcgcgacgatccaggccgaggcgttcagccagatgagcggcatccagaccgagaacaccacggactcgggcggcggcacgaacgtcgggtggatagacgccggcgactggctctcgtaccagaactcgcccgtgaccatcccggcgacgggcacctaccgcatcgagtaccgggtcgcgagcctgaacggcggcggcgggctcaggctcgaggctgcgggcggcagtccggtgtatggccaactcgcggtcccgggcacggccggctggcagaactggacgaccatctcgcacacggtcacgttgaacgccggcacgctgcgcttcggcatcaacgccatctccgggggctggaacctcaactggttccgcatcgtccgcgtgagttga

SEQ ID NO: 274 - protein, 469 aa, Unknown
  Obtained from environmental sample
  SIGNAL (1)...(34)
  DOMAIN (43)...(298): Cellulase (glycosyl hydrolase family 5)
  DOMAIN (345)...(467): Carbohydrate binding module (family 6)
  SITE (162)...(171): Glycosyl hydrolases family 5 signature. Prosite id = PS00659
  SITE (313)...(316): N-glycosylation site. Prosite id = PS00001
  SITE (364)...(367): N-glycosylation site. Prosite id = PS00001
  SITE (438)...(441): N-glycosylation site. Prosite id = PS00001
MDAGDMNMKFENRIGRFTRWCSLVAIVGVAPAFADVAPLSVSGNQIRAGGQPASFAGNSLFWSNTGWGGEKYYNANVVRWLKTDWKSTIVRAAMGVDDQGGFLQDPTGNRNRVKAVVDAAIANDLYVIIDWHSHHAENYRSQSIAFFQEMARTYGHRNHVIYEIYNEPLQVSWSGTIKPYAQAVISAIRAIDPDNLIVVGTPTWSQDVDVAAADPIAGTNIAYTLHFYAGTHGQYLRDKAQTALNRGVALFVTEWGSVNANGDGAVATAETNNWMTFLKSRGISHANWATNDKAEGASALVPGASTSGNWTANQLTASGALAKQIISGWGGTTPNPPGNVIATIQAEAFSQMSGIQTENTTDSGGGTNVGWIDAGDWLSYQNSPVTIPATGTYRIEYRVASLNGGGGLRLEAAGGSPVYGQLAVPGTAGWQNWTTISHTVTLNAGTLRFGINAISGGWNLNWFRIVRVS

SEQ ID NO: 275 - DNA, 876 bp, Unknown
  Obtained from environmental sample
atgttcggtaacaataaaactgtccggttgaccgttgtttcagggctgaccatgttggccgccggttgtgcgaccgcgccatgcgagcagcctgtcgccgcggcaccggcgccgtccgcctcgaccaccggtggcttacccgcgctgctgtcggagggcaccgtgataaaacagtcggcggcggactgggccaaatttactatcgagaactacgaagtcatcaacaacgtctggaataagaacgccgcttcgggtccgtacaaccaggaaatattcataaaggaagacaaggacgggaatcaggtattcggctggagatggcgcggcaagggcggcaatgtgctcgcgtatccggaagtgaacatcggcgccaagccctgggatccgccgccgtcgctgaagtccgatttcccgttcgccgtcggtgccaaggacatcgtcgtcgatttcgacgtcacgctcaaggcgagcggccgctacaacatggcgttcgagctctgggtcgtcaaagcgctgccgccgacgcaggcgacgatctcgaaagaaatcatgatctggaaccacaacagcgggatgacgccacagggatcgtattccggcacgatcgaggttggcggcgttaaatacgacgcctacatccgtgccgtccatggcgacgaatcgggcgcgaatgccaataaatggtcgtatatggcctttgtcgcgcagacgtccgtcttcaagggcagcttgccgctcaaacccttcatcgacttcttggtgcagaagggcgccctgagcagcaaggactacatcgccaatctcgagtggggcaatgaagtcatcgaaggcgaaggcgtggcggaaatccgccgcttcagggtgaaggcgcaatag

SEQ ID NO: 276 - protein, 291 aa, Unknown
  Obtained from environmental sample
  SIGNAL (1)...(34)
  DOMAIN (133)...(291): Glycosyl hydrolase family 12
  SITE (5)...(8): N-glycosylation site. Prosite id = PS00001
MFGNNKTVRLTVVSGLTMLAAGCATAPCEQPVAAAPAPSASTTGGLPALLSEGTVIKQSAADWAKFTIENYEVINNVWNKNAASGPYNQEIFIKEDKDGNQVFGWRWRGKGGNVLAYPEVNIGAKPWDPPPSLKSDFPFAVGAKDIVVDFDVTLKASGRYNMAFELWVVKALPPTQATISKEIMIWNHNSGMTPQGSYSGTIEVGGVKYDAYIRAVHGDESGANANKWSYMAFVAQTSVFKGSLPLKPFIDFLVQKGALSSKDYIANLEWGNEVIEGEGVAEIRRFRVKAQ

SEQ ID NO: 277 - DNA, 1011 bp, Unknown
  Obtained from environmental sample
atgaaaaccaaatcaatttattctatcgcaatcctgtcaatcgcgctgttcttttttacaactgcgcaaaccttttcacaaaccccggtagagttgcacggacgactcagggtatcgggaaaccagattgtgggtgaacatggcaacccggtacagctgatgggcatgagcctgttctggtctgtctggggtgccgagaagtattacaatgcagaagtggtaaactggcttgtaaaagactggaagattgacctgatccgtgctgccattgccgtggaagttaaccaggaaggcgatggaaacaaaggatggctattcaacaaggagggacaatacaaactagccgaaaccattatccaggcagccattgacaatgggatttatgtattggtagattggcatacccatcgcacccataccgatgctggcatcgagtttttcggttacctggcccaaaagtatggccggcaccccaacctgatttgggaaaccttcaacgagccggtaaaccaaagctgggaagagatcgctgagtttaccaatgctgtgaccggtgccattcgcccttacagcgataacctgatcattgccggtacacgccgatggagccagctggtgaacgaacctgccgacaatccgcttcccgacaaaaacactgcttattccctgcacttctatgccggaacccatggccaggaattgcgcgatattggtgattatgccctttcaaaaggtatcgccttattcattaccgaatgggggacctcccatgccgatggcgggcgcgatatgattgtacacgaagagaaagcacaggaatggatcgattgggcaatggagcgcaaccttagcatggccaactggtcattgtttgacaaggaagaggcttcagccgctcttaatcccgatgccccggtcaacggaaactgggatcccgaaaaacatctttccaaatcgggaaggtttgtaagggatcaaatcatacgcattaatagtaaaaaacacaactaa

SEQ ID NO: 278 - protein, 336 aa, Unknown
  Obtained from environmental sample
  SIGNAL (1)...(26)
  DOMAIN (41)...(298): Cellulase (glycosyl hydrolase family 5)
  SITE (162)...(171): Glycosyl hydrolases family 5 signature. Prosite id = PS00659
  SITE (172)...(175): N-glycosylation site. Prosite id = PS00001
  SITE (286)...(289): N-glycosylation site. Prosite id = PS00001
  SITE (291)...(294): N-glycosylation site. Prosite id = PS00001
MKTKSIYSIAILSIALFFFTTAQTFSQTPVELHGRLRVSGNQIVGEHGNPVQLMGMSLFWSVWGAEKYYNAEVVNWLVKDWKIDLIRAAIAVEVNQEGDGNKGWLFNKEGQYKLAETIIQAAIDNGIYVLVDWHTHRTHTDAGIEFFGYLAQKYGRHPNLIWETFNEPVNQSWEEIAEFTNAVTGAIRPYSDNLIIAGTRRWSQLVNEPADNPLPDKNTAYSLHFYAGTHGQELRDIGDYALSKGIALFITEWGTSHADGGRDMIVHEEKAQEWIDWAMERNLSMANWSLFDKEEASAALNPDAPVNGNWDPEKHLSKSGRFVRDQIIRINSKKHN

SEQ ID NO: 279 - DNA, 1992 bp, Unknown
  Obtained from environmental sample
atgaaaaaactgattctaacactctttagcttatgggctatatccgcctatgcacaagacgatatacggttaaaccaggtgggattctatcctgctgctgaaaaggtggctgtaattctgtccgatgagcaaatctcttttcaattgctggatgatgagaccggtgatgtggtttttaccggtgagtcatcaaccccaaacacatggccctattcggaagagaccgtggtactggctgactttagtgagtttacggaagcgggaatgtacagggtggctgtagagggaaagtccgactcatatcctttcactattgctgataacgcacttggtgaggtggccagagcatcggtgcgatacttctactttaaccgagcctcaacagcgctggaggagcagtttgcgtggcgatgggcacggccgatgggccatccggacgaagagatcattgtccacgcctctgctgcaaccgatgagcgcccggaagggtacacctttgcagcgccaaaagggtggtacgatgcgggcgattttaacaagtatgtagtgaactcgggcatcagcacctacaccctgatggcggcctatgagcactatccggaattttatactgcgctggatttaaacatacctgagagtgagagcggaaacccggatattttggctgaaatacgatggaacctcgactggatgatgcagatgcaggacccgaacgatggcggggtataccataaacttacgactctgaacttttccgggcaggtgatgccccaccaggcaagggcaaaccgttatgttgtgatgaaatctaccgcggccgcgctgaactttgctgcggtgatggcggtagcttcgagggtatacgaaccatttgatccagatttttctgagcaggcgattgaggctgcaaaatatgcgtgggagtgggcaaatgaaaaccctgaggtctattatcagcagccatccggtgtgtttacaggggagtatggcgacagtgatctctcagatgagttcgactgggctgcggccgaactctacatcacaacagggaatgacagctattgggatgcattcaatgaatcggcacaagtcggaattccatcatggcagttcgtgcggccccttgcctggatctcactggcacaccatctcgagaacctgaccgatgccgctaaccaagagcttatcagtgcacgaatcatcaaccaggcaaatacgctcagaaacgagtatgagtcatcagcttacggtatttcgatgggccaggagccgtggcagtttttgtggggcagcaacgcgatggcgctgaaccactcggttctgctgatccaggcttaccggctcacttgggatgaaacctatctcgatgcagcacaatccaatctcgattacattctcggcagaaatgcaaccgggtactcttttgtaaccggccacggcagcagaacgcctatgaatccccatcaccgtcaatcggcagcggataataacaccgatcccgttcccggaatggtcgtgggcggcccgcacgacggccagcaggataactgcaactacccatcggatctgccggcaaaatcgtatctcgatgcgtggtgcagctactccaccaacgaagtggcaatcaactggaacgcggcgcttgcatatgtatcgggagcggtagactattcccgttccggtatattggaaacaagtagtgaaacggaaccgtcagcggaacagccggttaccgtagagctgagtcaaaactaccccaatccttttaatcctgtgacggttattggatatcagttaccggtaagcagtgacgtacggcttgaggtattcgatatgctcgggcgccaggttgccacacttgtggatagccgccagcaagccggcacccatcaggccgaattcgacgcctccaacctgtccagcggagtatatctctaccgtttacaggccggaaatgtagtacaaataagacagatggtcttggtgaagtag

SEQ ID NO: 280 - protein, 663 aa, Unknown
  Obtained from environmental sample
  SIGNAL (1)...(18)
  DOMAIN (14)...(101): N-terminal ig-like domain of cellulase
  DOMAIN (109)...(555): Glycosyl hydrolase family 9
  SITE (253)...(256): N-glycosylation site. Prosite id = PS00001
  SITE (356)...(359): N-glycosylation site. Prosite id = PS00001
  SITE (364)...(367): N-glycosylation site. Prosite id = PS00001
  SITE (391)...(394): N-glycosylation site. Prosite id = PS00001
  SITE (443)...(446): N-glycosylation site. Prosite id = PS00001
  SITE (476)...(479): N-glycosylation site. Prosite id = PS00001
  SITE (481)...(497): Glycosyl hydrolases family 9 active sites signature 1. Prosite id = PS00592
  SITE (503)...(506): N-glycosylation site. Prosite id = PS00001
  SITE (536)...(554): Glycosyl hydrolases family 9 active sites signature 2. Prosite id = PS00698
  SITE (647)...(650): N-glycosylation site. Prosite id = PS00001
MKKLILTLFSLWAISAYAQDDIRLNQVGFYPAAEKVAVILSDEQISFQLLDDETGDVVFTGESSTPNTWPYSEETVVLADFSEFTEAGMYRVAVEGKSDSYPFTIADNALGEVARASVRYFYFNRASTALEEQFAWRWARPMGHPDEEIIVHASAATDERPEGYTFAAPKGWYDAGDFNKYVVNSGISTYTLMAAYEHYPEFYTALDLNIPESESGNPDILAEIRWNLDWMMQMQDPNDGGVYHKLTTLNFSGQVMPHQARANRYVVMKSTAAALNFAAVMAVASRVYEPFDPDFSEQAIEAAKYAWEWANENPEVYYQQPSGVFTGEYGDSDLSDEFDWAAAELYITTGNDSYWDAFNESAQVGIPSWQFVRPLAWISLAHHLENLTDAANQELISARIINQANTLRNEYESSAYGISMGQEPWQFLWGSNAMALNHSVLLIQAYRLTWDETYLDAAQSNLDYILGRNATGYSFVTGHGSRTPMNPHHRQSAADNNTDPVPGMVVGGPHDGQQDNCNYPSDLPAKSYLDAWCSYSTNEVAINWNAALAYVSGAVDYSRSGILETSSETEPSAEQPVTVELSQNYPNPFNPVTVIGYQLPVSSDVRLEVFDMLGRQVATLVDSRQQAGTHQAEFDASNLSSGVYLYRLQAGNVVQIRQMVLVK

SEQ ID NO: 281 - DNA, 1383 bp, Unknown
  Obtained from environmental sample
atgtttactcgaaattgtttgcacgctattttaattgttggcctgctttctgcctgtggaggccaggacaaaagtgatcgtcgtcagggaaccagccgcatttcatcgctaactattggcaagtttaacccaaatggtgacaacccacagtggtcgactttgaaactggcaatggaaaatatcgatcagggagctttgtttcttgaaagaacctatagcatcagtgatttttccagtgatttggcagaggatctgcttgtcaaagttccttttggtcgctatcgactgaacttgttatattatagtcaacagggaaatttgctctatcagtcatgtccagaagagattcagcgggaacacgtaatcgatactgctcgctatagggcggatatagccatctgccgcgaatctagtgatgaaccggtaggtcaggtcccaattgaaccggtaagtgaggttatcatcagtccgcagcccgatcgaacgggtgaaaacggcggaaatgcaccaggccaggagggtggaaatttctggattgatcccgattcccaggcgatgcttgatttcaggcaaatgcaacagtccggacacccagatgctcgctatattgagtatattgccaagcagccagcggctgtgtggtatggcgagtggagcggaaatatttctcaagccgttcgtcagcatatcgccggtgcgaatgcgcataatgcctacgcactcatgattgcttacaaaattcctgagcgggattgtggacagcattcatcaggtgggctgagagcagacgcttatcgaaattggattcgggattttgcaaacgctattggctcggcaaaggcaattgttgtgctagaacctgatgctcttactttgatggagtgtctggatagtgacggcgtagcgctgagatacgagctactcaattttgccctcgcccagtttaagtcaaagcccaatacccgggtctacattgatgcaggacactccgcatggctgtccgcgcaagaactggcagatcggctaagactggctggcattagccgtgccgatggtttttctttgaacacatcgaattatcaaacgaccgaatcgaatattcgctacggccaggaagtccgcaacttgctgggtggtggtatcaacttcatcgtcgataccagtcgtaatggcaacggaccaactcctgacgccgaatggtgtaatccgcgagggcgggccttgggtcaaacaccaactttcagtacaggcgttaccggtgttgacgcatatttgtggctaaaacgtccgggcgagtctgatggctattgtaatggtggtcctgcagccggtgcctggtggcgggaattggctatcgaatatgcaaaaaacgccggtatctaa

SEQ ID NO: 282 - protein, 460 aa, Unknown
  Obtained from environmental sample
  DOMAIN (179)...(449): Glycosyl hydrolases family 6
  SITE (224)...(227): N-glycosylation site. Prosite id = PS00001
  SITE (361)...(364): N-glycosylation site. Prosite id = PS00001
MFTRNCLHAILIVGLLSACGGQDKSDRRQGTSRISSLTIGKFNPNGDNPQWSTLKLAMENIDQGALFLERTYSISDFSSDLAEDLLVKVPFGRYRLNLLYYSQQGNLLYQSCPEEIQREHVIDTARYRADIAICRESSDEPVGQVPIEPVSEVIISPQPDRTGENGGNAPGQEGGNFWIDPDSQAMLDFRQMQQSGHPDARYIEYIAKQPAAVWYGEWSGNISQAVRQHIAGANAHNAYALMIAYKIPERDCGQHSSGGLRADAYRNWIRDFANAIGSAKAIVVLEPDALTLMECLDSDGVALRYELLNFALAQFKSKPNTRVYIDAGHSAWLSAQELADRLRLAGISRADGFSLNTSNYQTTESNIRYGQEVRNLLGGGINFIVDTSRNGNGPTPDAEWCNPRGRALGQTPTFSTGVTGVDAYLWLKRPGESDGYCNGGPAAGAWWRELAIEYAKNAGI

SEQ ID NO: 283 - DNA, 1188 bp, Unknown
  Obtained from environmental sample
atgcgtaagatcgtaaaacaaataaattaccttacccctagtgtactgggtcttctggtgctgagtctcttctttcaggttcccactcaagcttcacaccccctgctgagcacgccaaattatctgcatacctccggcagtcaaatcctggatgcatcaaataaagttgtcgggttgagcggaatcaactggtttggatttgagacagccaataacgttccacatggtttatgggcacgtggttgggaagatgtgctcgatcagatcaagaaggaaggatacaacgtcattcgacttccattctcgaatgccatgctcaagaaagatgtaatgccttcgggtattgattaccagaagaatccagacctcgaggggctgacgtccctgcaggtgatggacaagatcattcgaggagccaatgatcggggactcaagatcatcctggataatcaccgttccacatcgggtggcggaccggagtcaaacggcttatggtacacaagcgaatattcggaaaacgattggatcctcgattggaagaaacttgtccgccggtacaaatacatcccggctgtaatagccgttgatcttcgtaatgaaccgtataatgcctgctggggctgtggggatccatccaaggattggagactggcgtcggagaaagccggcaatgccgtgctttcggtaaatcccaatctgttagtgattgtcgagggtgttgctgtccataatggtcaaaacacatggtggggcggtaatttgctaggtgcgaaagaatttccagtccgcctgaatgtgccgcaccggttggtgtattctgcacatgaataccctgagacgatctaccctcaaccgtggtttaccgattcgaattatcccaataaccttgcggctgtttgggataaatactggggttacctggtcaaggaaaatattgctcctgtcttgatcggcgaattcggcacacgacttgaaacagaaaaagataagcagtggctatcccaattccaggaatatgttcggcaacacaaaatcagttggacgtactggtcgctcaatccaaactctggtgacacaggcggattgctgcaggacgattgggtcaccatccaccagacgaagcaaagcatcctcaggcaaattcaatatcccttcattcctcagttcgccaacctccaggaaaaataa

SEQ ID NO: 284 - protein, 395 aa, Unknown
  Obtained from environmental sample
  SIGNAL (1)...(31)
  DOMAIN (47)...(360): Cellulase (glycosyl hydrolase family 5)
MRKIVKQINYLTPSVLGLLVLSLFFQVPTQASHPLLSTPNYLHTSGSQILDASNKVVGLSGINWFGFETANNVPHGLWARGWEDVLDQIKKEGYNVIRLPFSNAMLKKDVMPSGIDYQKNPDLEGLTSLQVMDKIIRGANDRGLKIILDNHRSTSGGGPESNGLWYTSEYSENDWILDWKKLVRRYKYIPAVIAVDLRNEPYNACWGCGDPSKDWRLASEKAGNAVLSVNPNLLVIVEGVAVHNGQNTWWGGNLLGAKEFPVRLNVPHRLVYSAHEYPETIYPQPWFTDSNYPNNLAAVWDKYWGYLVKENIAPVLIGEFGTRLETEKDKQWLSQFQEYVRQHKISWTYWSLNPNSGDTGGLLQDDWVTIHQTKQSILRQIQYPFIPQFANLQEK

SEQ ID NO: 285 - DNA, 2550 bp, Unknown
  Obtained from environmental sample
atgaaaaaggtaagtaatgcacgtgtattgagtttcctattaatacttgttctcatttttgggaatctagcttctgtttttgcaatagaaaattcggatgatagtagtttactaggtaatgataaggtacttaatccttcccaagctggagccctacaaattatagatatagatggtcaaaggaccttaggaactattgatggagatcctattcaattaagaggaatgagtacccatggtcttcaatggtttggagagattataaatgataatgcctttgctgcattagctaatgattgggaatctaacatgatacgactagcgatgtatattggcgaaaatggttatgctaccaatccgagtgtaaaagatttagtgtatgaggggatagaactcgcctttgagcacgacatgtatgtgattgtagactggcatgttcacgcaccaggggatccgagggcagatgtatactccggagcgtatgagttctttgaagagttggcagatcattataaggatcatccaaaaaatcattatattatctgggagcttgcaaacgaaccaagttctaataataacggaggtccaggaatacctaataacgaagaaggctggcaagccgtaaaagaatatgctgaacctattgtagatatgcttcgtgaaaagggagataatatcattcttatcggtagcccaaactggagtcagcgaccagatttagctgcggataatccaatcgatgcggaaaatatcatgtactctgttcatttttatactggaacgcataccccatcagaggatagttacccaccaggcacccctaatacagagcgatctaatgtgatgagtaacgcaagatatgcattagaaaatggtgttgctttgttcgcaacagaatggggtactagtgaagctagtggggataatggaccgtttttagatgaagctgatgtttggcttagttttctaaatgaaaacaacatcagttgggcgaactggtccttaacgaacaaaaatgaaacttcaggagcttttacaccatttatactaaatcaatccgatgcaacgaagcttgatccaggtgatgatcaagtttggtctatggaagagttaagtatctcaggggagtatgttcgtgcaagaattaaaggaattgaatatgatccaattaatcgaacaccaagtgaagattatacaaaagtcatttgggattttgacgatgggacaacgcaaggattccgtgtgaacggggacagtcctattcaagatattcaattagataatgttgataattcattagaaataagtggtcttgatgctagtaacgacacatcagaaggaaattactgggccaatgtacgtttgtcttcagatggatataatcctggggtagacattttaggggcagaggagcttataatggaagtaatcgtggaggaaccaactacagtttctattgcagctattccacaaagttcgaatcacggttgggcaaatcctactcgggcagtaaaagtgacacctgaggattttgagttacaaggagatggaaagttcgttgcaccattatccataacaacagatgatgctccaaacttaaataatatcggaaacgatacagataatagtatgcttacaaacttgattttatttataggtacggaaaatgcggatgttatttcattggataacatctctgtatctggaaatagagaagtaattgttgatcctatagaacatggcccacttggcgtggcaactctaccatctgattttgaggatggcacaagacaaggatggtcttggaatagtgaatccggagtaagagaagctctaactattgaagaagcaaatggttccaacgcactctcctgggaatatgcttacccagaagtaaagcctgaggatgggtgggcatctgcacctagattagatctctggatagaagaactagtcagaggagagaatgattttgttgcgtttgatttttacctagaccccgttcgtgcaacggagggagcaatctctattcatacggtatttcaaccaccagcttcaagttactgggcacaagctccttcgacctttaacatcgaacttgaagaattaaatgaagctaaagtgacaactgatggattataccactatgaagttgcgataaatattcgggatataaataatattgaggacgatacagagctacggaacatgatgttcattttcgcagatatggacagcgactttgccggtcgagtttttattgataatattcggtttgaattgacaacaatcacggtagacgacattttcgaaaaaattgatagttttgttgagaatggggatataagacaccccgcaggagttcaattaacaaatacactgagaacggcagaacgacactataataatggtaaaagtaagcaatctcaaacacatctaaataaatttcactctattattgagggtaatatgatgaagaacgtttctaatgaagtgaaaaaagtattgcgggatgatatagatcgtctttctagtctgtggtttgattaa

SEQ ID NO: 286 - protein, 849 aa, Unknown
  Obtained from environmental sample
  SIGNAL (1)...(28)
  DOMAIN (64)...(343): Cellulase (glycosyl hydrolase family 5)
  DOMAIN (365)...(568): Carbohydrate binding domain (family 17/28)
  DOMAIN (570)...(760): Carbohydrate binding domain (family 17/28)
  SITE (182)...(191): Glycosyl hydrolases family 5 signature. Prosite id = PS00659
  SITE (236)...(239): N-glycosylation site. Prosite id = PS00001
  SITE (332)...(335): N-glycosylation site. Prosite id = PS00001
  SITE (337)...(340): N-glycosylation site. Prosite id = PS00001
  SITE (344)...(347): N-glycosylation site. Prosite id = PS00001
  SITE (356)...(359): N-glycosylation site. Prosite id = PS00001
  SITE (439)...(446): Aldehyde dehydrogenases glutamic acid active site. Prosite id = PS00687
  SITE (448)...(451): N-glycosylation site. Prosite id = PS00001
  SITE (546)...(549): N-glycosylation site. Prosite id = PS00001
  SITE (572)...(575): N-glycosylation site. Prosite id = PS00001
  SITE (627)...(630): N-glycosylation site. Prosite id = PS00001
  SITE (839)...(842): N-glycosylation site. Prosite id = PS00001
MKKVSNARVLSFLLILVLIFGNLASVFAIENSDDSSLLGNDKVLNPSQAGALQIIDIDGQRTLGTIDGDPIQLRGMSTHGLQWFGEIINDNAFAALANDWESNMIRLAMYIGENGYATNPSVKDLVYEGIELAFEHDMYVIVDWHVHAPGDPRADVYSGAYEFFEELADHYKDHPKNHYIIWELANEPSSNNNGGPGIPNNEEGWQAVKEYAEPIVDMLREKGDNIILIGSPNWSQRPDLAADNPIDAENIMYSVHFYTGTHTPSEDSYPPGTPNTERSNVMSNARYALENGVALFATEWGTSEASGDNGPFLDEADVWLSFLNENNISWANWSLTNKNETSGAFTPFILNQSDATKLDPGDDQVWSMEELSISGEYVRARIKGIEYDPINRTPSEDYTKVIWDFDDGTTQGFRVNGDSPIQDIQLDNVDNSLEISGLDASNDTSEGNYWANVRLSSDGYNPGVDILGAEELIMEVIVEEPTTVSIAAIPQSSNHGWANPTRAVKVTPEDFELQGDGKFVAPLSITTDDAPNLNNIGNDTDNSMLTNLILFIGTENADVISLDNISVSGNREVIVDPIEHGPLGVATLPSDFEDGTRQGWSWNSESGVREALTIEEANGSNALSWEYAYPEVKPEDGWASAPRLDLWIEELVRGENDFVAFDFYLDPVRATEGAISIHTVFQPPASSYWAQAPSTFNIELEELNEAKVTTDGLYHYEVAINIRDINNIEDDTELRNMMFIFADMDSDFAGRVFIDNIRFELTTITVDDIFEKIDSFVENGDIRHPAGVQLTNTLRTAERHYNNGKSKQSQTHLNKFHSIIEGNMMKNVSNEVKKVLRDDIDRLSSLWFD

SEQ ID NO: 287 - DNA, 1023 bp, Unknown
  Obtained from environmental sample
atgactcgaaactggcttggcaagatattggcggcattgcttttggcgggatgcgccatacccgccccggcgcaatcgccgtcctccgatgagcccgccttcgcggcgccggttccgcccgctggcagcccggtcgctcgccacggcgcgttgtcggtcagcggaaaccggatcgtcgatgcgcatggccagcccgtcaccttgcggggcatgagcctgttctggtcgcaatgggcgccgcaatattacaccggcgaaacggtcgactggctggtcaaggactggaagatcaccgccatccgcgcggccatcgccgccgagaccaatgacagcgcgcgccagcatttcgagcgtgaattcgccaaggccggccgggtgatcgaggcggcggcgcgcaacggcatctatgtgattgtcgattggcacgcgcaccggcagtaccccgtcgaggcggagcagtttcttaccgccatcgcccggcgatacggccatctgcccaatctgatctacgagccgttcaacgagccgctgcgcgaaggcgtcgattggtcgcgtgacgtgaagccctatcaccagcgggtcgtcggggcgatccgggcgatcgatcccgacaatctggtgatcgtcggcagtcccagctggagccaggatgtcgatatcgcggcgctggacccgctcgatttccccaatgtcggctacacgctgcattattacgccggcacccaccgtcaggagctgcgcgacaagggcgatgctgcgctggccgccgggctggcgctgatggtgaccgaattcgggatcgtcgatgccaccggcgacggtccgatcgatctgccgtcgagcgaactgtggtgggactgggccgaagccaacggcgtctcgtggctcgcctggtcgaccggcgaccgcgacgagaccagcgcgacgctgaaaccgggcaccgcgccatcgggctggagcgaagacgatctgacccaatccgggaaaatccttcgcgcgcggctgcgggcggcggcggaatga

SEQ ID NO: 288 - protein, 340 aa, Unknown
  Obtained from environmental sample
  SIGNAL (1)...(24)
  DOMAIN (56)...(308): Cellulase (glycosyl hydrolase family 5)
  SITE (110)...(113): N-glycosylation site. Prosite id = PS00001
MTRNWLGKILAALLLAGCAIPAPAQSPSSDEPAFAAPVPPAGSPVARHGALSVSGNRIVDAHGQPVTLRGMSLFWSQWAPQYYTGETVDWLVKDWKITAIRAAIAAETNDSARQHFEREFAKAGRVIEAAARNGIYVIVDWHAHRQYPVEAEQFLTAIARRYGHLPNLIYEPFNEPLREGVDWSRDVKPYHQRVVGAIRAIDPDNLVIVGSPSWSQDVDIAALDPLDFPNVGYTLHYYAGTHRQELRDKGDAALAAGLALMVTEFGIVDATGDGPIDLPSSELWWDWAEANGVSWLAWSTGDRDETSATLKPGTAPSGWSEDDLTQSGKILRARLRAAAE

SEQ ID NO: 289 - DNA, 1971 bp, Unknown
  Obtained from environmental sample
atgattggcgttaatctcgctggggcagaattcggcagtgtgggtcagccgtttggagtcggctatatttacccgagcaaagcgaacatcgattactatgcgtcgcacggcatggagctgatccgcctgccgttccgctgggagcggatccagccgcagcaggacgggccgctcgaccaggccgaactcgcgcgcatccgtgaagtcgtggactacgcggcctcgaagggcatgacggtcgccctcgacgtgcacaattacgggatgtcctacggcggcaagctgatcggcagcgccgagcttcccaactcttccttcgcgaacctctggtccaagctcgccacggagttccgcgacgacggcaacgtgtggttcaacatcatgaacgaaccgcacaagcagtcggcgacgcagtggatcgaatcggccaacgccgcgatcgccgcgatccgcgacgcgggtgcggaccagaagattctcgtccccggcacctactggtcgggcgcgcattcatggatgacgagcgacaaccacagcgtcgtcggcaacggcgtcaaggacccgctgaacaacttcgcgttcgacgtgcaccagtacttcgacaacgacagcagcggcaccagcacgcaggtcgtctccgagaccatcggcgtcgagcgcctgagggcgatcaccgagtgggcgaaggcgaacgggcacgagctcttcctcggcgagttcggcgtggggaccgacgccaggagcctcgccgccctcgacaacatgatgaagtacatgtcggagcatcccgacgtgtggatcggcgccacctactgggccggcggcccctggtggggcgactactacttctccctcgagccgaagaacggcgtcgacaagccccagctcgcgatcctcatgaagtacgagatcggcccgaacggggaagaggtggccacgccggtggtcgtcgagcccgagacggcggaaagcgacgagccggtgcaggaggaggccgagcaggccgtcccgccggtgaccgccgaggacggagacgcgccgtccgaggacgaggccgccgctccccccgccgaggaggacgcgcctacggatgaggaggacgacgcggaggacgacggcggcgacgagcagcccgtctcgcgccttccggaagcctccgaggatccggtcgacgaaacgacgcccgacgaagagcccgtcgccgcggctcccgaggtcgaggacgaagtcgaggacgaagccgaaatcgagccggagacgccggtcgccgtcgaggaaccggttgtcgacgagccggaggtgacccaaggtcccgtcgccgctcagccctccacggtgcgcatcgaccacgccgacggcgagggcgaccattatcgcgaaggcgagcgcatgggctacaagatcaccgtcgaaaacgcccaggccggccagaccttccatatctggatggccaatacggcgggcgccgacgatttctccgggggcttcctcgaggatctgcaggcggctgcgcccgagggcgtgggcgtgcggatgatcagccccaccaaggccgagatcacgctcaaggaaggcagctacgacttcaccttcttccgcgacaccatgatcaatgcgggggcggagaaggcggaccaggctccgtggaacgccgagagcttccagcagatcgacttctggatcagcgacttcaccgggggcctgaccccgaccgcccgggtttcgtcgagctggattgaagacacgcggcccgatgaagcgccgatcgtgtcggctccggaggcggtgaacacggaaactcccgaggtcgaggccgctcccgcagaagcggcgcagcccgctcccgtcgcggaggcgcccgctgccacggtcgattggcagaagcttctggccgatctcctcgccaatgccggcgagggcgccccggagggcggcttcagcgagacgaagatcttgttcagtccgctttga

SEQ ID NO: 290 - protein, 656 aa, Unknown
  Obtained from environmental sample
  DOMAIN (3)...(282): Cellulase (glycosyl hydrolase family 5)
  SITE (104)...(107): N-glycosylation site. Prosite id = PS00001
  SITE (179)...(182): N-glycosylation site. Prosite id = PS00001
  SITE (205)...(208): N-glycosylation site. Prosite id = PS00001
MIGVNLAGAEFGSVGQPFGVGYIYPSKANIDYYASHGMELIRLPFRWERIQPQQDGPLDQAELARIREVVDYAASKGMTVALDVHNYGMSYGGKLIGSAELPNSSFANLWSKLATEFRDDGNVWFNIMNEPHKQSATQWIESANAAIAAIRDAGADQKILVPGTYWSGAHSWMTSDNHSVVGNGVKDPLNNFAFDVHQYFDNDSSGTSTQVVSETIGVERLRAITEWAKANGHELFLGEFGVGTDARSLAALDNMMKYMSEHPDVWIGATYWAGGPWWGDYYFSLEPKNGVDKPQLAILMKYEIGPNGEEVATPVVVEPETAESDEPVQEEAEQAVPPVTAEDGDAPSEDEAAAPPAEEDAPTDEEDDAEDDGGDEQPVSRLPEASEDPVDETTPDEEPVAAAPEVEDEVEDEAEIEPETPVAVEEPVVDEPEVTQGPVAAQPSTVRIDHADGEGDHYREGERMGYKITVENAQAGQTFHIWMANTAGADDFSGGFLEDLQAAAPEGVGVRMISPTKAEITLKEGSYDFTFFRDTMINAGAEKADQAPWNAESFQQIDFWISDFTGGLTPTARVSSSWIEDTRPDEAPIVSAPEAVNTETPEVEAAPAEAAQPAPVAEAPAATVDWQKLLADLLANAGEGAPEGGFSETKILFSPL

SEQ ID NO: 291 - DNA, 1893 bp, Unknown
  Obtained from environmental sample
atgcgcagatttcgagttgtattccttggtctttttgttttttttggtattgttatcgctagccagtatgggcagacagcagctgcatacgttccaactgtctgtgatgcagacttcaatcacgacaccacagtcaacgttttggactttgcggtcatggcaaacaacttcttcaagtcgcctctcatcaatccagaagctgacttaaaccgagatggttacgtcaacatttttgactttcactacatgcagatgttcctgtttgagaactgtgttccttccagctctccatcacctccagtcagtccgtcaccagctgttagtcccagtccaagcgtctcaccatctcccttacctccaactgacgtaaccatgtccatcagcacttcagtcagtagtcctatctcaccctatatttatggaacgaactccaagaactacgctcgttcaaagctgatcagggctggtggtaatcgttggacagcatataactgggaaaataacgcctccaacgcgggatctgactggaaccattcaagtgataactacttgtgtgacgccagcggtggttatgtctgtacaaactctacaaatcctggagaagctgtacgagttcgtattgcagacagccgaagtaagaatgcagcctcacttattactgtccctatcgtcgactacgtggctgcagacaaaaatggaaatgtctggacagctgccagtcctactaatgaacggtgggcccaaaatgctccgaccaagccagctgcagaagcttcagttatgggtgatcggaaggtctatcagaatgaatttgtcaattttattgagactacatttagcgatgctcataatggcacaggacctgaaatcttttatagcttagacaacgagccagcactctggccatcaacacatccatacgtgcatggtgccaagccgacctacgcggagatgacacaacgctccactaatacagccaagatgataaaagaccgagtccctaatgctaaagtttttggtaatgttgcatacgggtgggctgagtacaagaatctgcaggatgctccagattccagtacacgtgcccctggccaagtaggtaacacatatcttgattattatctcgcttcgatgaagaatcagtcagatacagctggaaaacgactagtcgatgtccttgacctccactggtacccagaggcacaggatccagtcagcaactgccggattactgactgtgctagcgacaccgaaagtaagattcaagctcgcgtgcaggcgccacgctcgctgtgggatacgacttatgttgagaagagttggatcactcaatgggacacgaacaatggcccaattaagctcattccagacataaagacgaggattgccaacaactaccctggtaccttactcgccttcagtgagtactactacggtggtggtaatcacatttctggtggaatcgctcaagctgatgtgttaggtattttcggtcgtgagggagtctatgcagccaatctatgggagctgcatggtgacaaccagtttatttggggggcattcgatatgtacctcaactataacggtagtggcgccagtgttggtgatcggagcgtaacagccagtaccagtgacgtagcaaagtcttctgtctatgcgatgacgaaacagggtgataactctcgagtatatgtgattgcgatcaataaaacagctagtccagtttctacgcttgtccagatagatcattctagagccttgacgactgctgaagtttatcagctgacgtcgacatcatcgacaccacaaacgagaccaacaatcagcgtctcaggcaaccgttttgtctatgccatgccggcatacagcgtgaccaccctggtagtaaggtag

SEQ ID NO: 292 - protein, 630 aa, Unknown
  Obtained from environmental sample
  SITE (69)...(81): EF-hand calcium-binding domain. Prosite id = PS00018
  SITE (170)...(173): N-glycosylation site. Prosite id = PS00001
  SITE (179)...(182): N-glycosylation site. Prosite id = PS00001
  SITE (197)...(200): N-glycosylation site. Prosite id = PS00001
  SITE (288)...(291): N-glycosylation site. Prosite id = PS00001
  SITE (385)...(388): N-glycosylation site. Prosite id = PS00001
  SITE (536)...(539): N-glycosylation site. Prosite id = PS00001
  SITE (577)...(580): N-glycosylation site. Prosite id = PS00001
MRRFRVVFLGLFVFFGIVIASQYGQTAAAYVPTVCDADFNHDTTVNVLDFAVMANNFFKSPLINPEADLNRDGYVNIFDFHYMQMFLFENCVPSSSPSPPVSPSPAVSPSPSVSPSPLPPTDVTMSISTSVSSPISPYIYGTNSKNYARSKLIRAGGNRWTAYNWENNASNAGSDWNHSSDNYLCDASGGYVCTNSTNPGEAVRVRIADSRSKNAASLITVPIVDYVAADKNGNVWTAASPTNERWAQNAPTKPAAEASVMGDRKVYQNEFVNFIETTFSDAHNGTGPEIFYSLDNEPALWPSTHPYVHGAKPTYAEMTQRSTNTAKMIKDRVPNAKVFGNVAYGWAEYKNLQDAPDSSTRAPGQVGNTYLDYYLASMKNQSDTAGKRLVDVLDLHWYPEAQDPVSNCRITDCASDTESKIQARVQAPRSLWDTTYVEKSWITQWDTNNGPIKLIPDIKTRIANNYPGTLLAFSEYYYGGGNHISGGIAQADVLGIFGREGVYAANLWELHGDNQFIWGAFDMYLNYNGSGASVGDRSVTASTSDVAKSSVYAMTKQGDNSRVYVIAINKTASPVSTLVQIDHSRALTTAEVYQLTSTSSTPQTRPTISVSGNRFVYAMPAYSVTTLVVR

SEQ ID NO: 293 - DNA, 1125 bp, Unknown
  Obtained from environmental sample
atgaaaaagattattttaaaatcaggtatactcttgttggtagttattttgattgtttctattttgcaaattttacctgtgtttgcccagagcacaccatatgaaaaagaaaaatatccacaccttcttggcaatcaagcggtcaaaaaaccctcggttgctggcagactgcaaattattgaaaagaacggtaaaaagtatttagctgatcaaaaaggtgaaataatccagcttcgtggcatgagtacacatgggcttcagtggtatggtgatattataaacaaaaatgcgtttgaagctctttcaaaagattgggagtgtaatgttgtaaggcttgcgatgtatgtgggtgaaggcgggtatgcttcaaatccaagcatcaaagaaaaagttatagaagggattaagcttgctattgagaatgacatgtatgtaattgttgactggcatgtattaaatcccggcgacccgaatgctgaaatttataaaggggcaaaagactttttcaaagagatagctacaagttttcccaatgactatcacataatatatgaactttgcaatgaaccaaatccaaatgaaccgggagtagaaaatagcttggatggttggaaaaaggtaaaggcttatgctgaacccatcataaagatgcttagaagtttggggaatcagaacattataattgtaggttcgccaaactggagccagagacctgactttgcaattcaagaccctataaatgataaaaatgttatgtattcagttcatttttattctgggactcacaaagttaatggatatgtttttgaaaatatgaagaatgcatttgaaaatggtgtgcccatttttgtaactgaatggggaacaagtttagcaagcggtgacggtggaccatatcttgatgaggcggacaaatggcttgaatatctaaatagcaactatattagctgggtgaactggtcactgtcaaacaaaaatgaaacatcagctgcttttgttccatatgttagtggcatgcatgatgcaacatcacttgacccgggcgatgataaggtgtgggatataaaagagctgagtatatctggagagtatgtgagggcaaggataaaaggaattgcatataag

SEQ ID NO: 294 - protein, 375 aa, Unknown
  Obtained from environmental sample
  SIGNAL (1)...(29)
  DOMAIN (66)...(330): Cellulase (glycosyl hydrolase family 5)
  SITE (184)...(193): Glycosyl hydrolases family 5 signature. Prosite id = PS00659
  SITE (236)...(239): N-glycosylation site. Prosite id = PS00001
  SITE (323)...(326): N-glycosylation site. Prosite id = PS00001
  SITE (331)...(334): N-glycosylation site. Prosite id = PS00001
MKKIILKSGILLLVVILIVSILQILPVFAQSTPYEKEKYPHLLGNQAVKKPSVAGRLQIIEKNGKKYLADQKGEIIQLRGMSTHGLQWYGDIINKNAFEALSKDWECNVVRLAMYVGEGGYASNPSIKEKVIEGIKLAIENDMYVIVDWHVLNPGDPNAEIYKGAKDFFKEIATSFPNDYHIIYELCNEPNPNEPGVENSLDGWKKVKAYAEPIIKMLRSLGNQNIIIVGSPNWSQRPDFAIQDPINDKNVMYSVHFYSGTHKVNGYVFENMKNAFENGVPIFVTEWGTSLASGDGGPYLDEADKWLEYLNSNYISWVNWSLSNKNETSAAFVPYVSGMHDATSLDPGDDKVWDIKELSISGEYVRARIKGIAYK

SEQ ID NO: 295 - DNA, 1095 bp, Unknown
  Obtained from environmental sample
atgaagcgtactcgatatggtgtacgaagcccgcgttccgcaccccggttcggtgtactgttcggtgcggcggcggcaggagtgctcatgactggtgctggtcaggaggcgcgttcggaaggcacccggctgacggctgcagctgcggtcccggcgtgggtcccgtcggtcccatcccctggttcgagccgggcggtgctggagacggcggtgctgtacgtggatccgcactcgacggcccggtcccaggtggaaagctggcgcagctcccgtccgcgggaagcagcgctgctggaccgggaagtggcgagtcagccctcggggatctggttcggcgactggaacaggtcggtccgcaacgacgtgagcgcggtgatgaccagtgccgcgcgccagggcgcgctgccggttctggtagcgtacaacatcccgctgcgggactgcggcagccactctgcgggtggtgccggcagcgccggggcgtaccggagctggatcggcgagttcgcccggggcctgaacggccgccgcgccatcgtggtcctggaaccggacgcgcttgcgtccaccgaatgcctgagcacggcgcagcggaacgagcggtttgcgctgctgaagcacgcaacggagacgctctcggcgcagggcgctctggtctatatcgacgcagggcacgcgcagtggctgagtgccgcagaaacggcgtcccggctgatccaggcgggcgtgcggagtgcggccggattctcgctgaacgtgagcaacttcatcggcaatgaagcgaacatccgcttcggcgatgacgtttcgcggcggacgggcggagcgcactacgtcatcgacacgagccgcaacggggccggccctacggcggacctgcagtggtgcaacccgtcgggtcgtgcgctgggcacgcggcccacgacgcgcacggcgcacgcgaagctggatgcgctgctgtggatcaagaagcccggagagtcggacggcagctgcaacggtggtccggcagccggtcagtggtgggcggactatgcgctgggtcttgcccagcggtccacgccggtcatggccctggcggatgcccggcgctga

SEQ ID NO: 296 - protein, 364 aa, Unknown
  Obtained from environmental sample
  DOMAIN (74)...(344): Glycosyl hydrolases family 6
  SITE (116)...(119): N-glycosylation site. Prosite id = PS00001
  SITE (141)...(157): Glycosyl hydrolases family 6 signature 1. Prosite id = PS00655
  SITE (181)...(190): Glycosyl hydrolases family 6 signature 2. Prosite id = PS00656
  SITE (255)...(258): N-glycosylation site. Prosite id = PS00001
MKRTRYGVRSPRSAPRFGVLFGAAAAGVLMTGAGQEARSEGTRLTAAAAVPAWVPSVPSPGSSRAVLETAVLYVDPHSTARSQVESWRSSRPREAALLDREVASQPSGIWFGDWNRSVRNDVSAVMTSAARQGALPVLVAYNIPLRDCGSHSAGGAGSAGAYRSWIGEFARGLNGRRAIVVLEPDALASTECLSTAQRNERFALLKHATETLSAQGALVYIDAGHAQWLSAAETASRLIQAGVRSAAGFSLNVSNFIGNEANIRFGDDVSRRTGGAHYVIDTSRNGAGPTADLQWCNPSGRALGTRPTTRTAHAKLDALLWIKKPGESDGSCNGGPAAGQWWADYALGLAQRSTPVMALADARR

SEQ ID NO: 297 - DNA, 2601 bp, Unknown
  Obtained from environmental sample
atgagaaaactactgactgctttattagtaacggtggcaataggagcaaacgcccaaatgctgccgtaccagaacccacagctaaccgcagagcaacgtgccgacgacttactaggtcgtctgacccttgacgagaaagtgaagctgatgatggacacctcgccagccattccgcgactgggcatcccgcaattccagtggtggaacgaggcgctgcatggtgtgggacgaaacggatttgccaccgtattccccatcacaatggcaatggcagcctcatgggacgatgctttggtgcacaaagtgtttaccgctgtcagcgacgaggctcgcgtgaaggcccaacaggccaagcgttctggaaatatccaacgctatcagagtctgtcattttggacacccaacatcaacattttccgcgatcctcgttggggtcgtggacaagagacctatggcgaagacccgtatcttaccactcaaatgggactggctgtggtgcgcggtctacaaggtgttggctatcagggcgaagacctgggcgtgagcaaatatcgtaagttactggcctgtgccaagcactttgccgtacatagcggtcctgagtggaaccgtcacaccttcaacattgagaacctgcccgagcgcgacctctgggaaacctatctgcctgccttcaaggctttggtgcaagaaggaaacgtggcagaagtgatgtgtgcctatcaacgtattgacgggcaggcctgctgcgcccagacccgctacgaacagcagatattgcgtgacgaatggggattcgacggactcatcaccagcgactgtggtgctatccgcgacttcctgcccaagtggcacaatgtggccaaagatggtgcagaagccagtgccaaagccgtattggctggtaccgacgtggaatgtggttcggaatataagaacctgcctgcagccatcaagcgtggcgacatcaaggagtccgaccttgacaagagtctgcgacgtctgctcatcgcccgctttgaactgggcgacttcgacagcgacgaagcaaacgcatggactaagataccagaaagcgtcatcgcttcgaaggaacataagaaactggcgttggatatggctcagaaaagcattgtattgctgaaaaacaatggagtattgccattgactcaatcgcagcccgcagaactggtggtaatgggaccgaatgccaacgattccgtgatgatgtggggcaactattcgggctaccccacccgtaccatcaccgctctggaaggtatcaatagatatttcaaagcacagacacccacagccaaggttcgctatatccaaggctgcggactgacccgcaacgaatcattcatcagtcgtttcgataaggtacagggccccttgggatatcagggtatgcaagccatctattggaacaataccgagatgaagggagagcctgtgactaccgttcacatcaaagatcccattcacttgagtaatggaggcaacaccgtttttgcccctggcgtaaacttagagaatttctctgctcgtctggatggtattttcaaacccactgaggatgaaacgctcatcttcgacatcagtgcagatgacaaaatgcgattgattgtgaacagcgacacattggttgacatctggaaggtgcgccatcgtattcagggagacaagaaagaactgaaggtgaaggcaggcgagcactatcgcatccagatagactacgtgcaggaaacgggttatggtgccttgaacttcgacatcaagaagaaggtaaacccaacccaacaggaattgttggcacagattggcaatgcagaaaccattatcttcgtgggtggcatctcacccagtctggaaggtgaagaaatgaaagtcagcgaacccggcttcaagggtggcgaccgtaccagcattgaactgcctcaagcacagcgcgacatgctggccatgctccacaaggctggcaagaaggttgtcttcgtcaactgctctggctctgcaatggcactgactccagaacttgagacctgcgacgccatcatccagtggtggtatgctggagaactgggtggatcagcattagctggtgttcttatgggtgacagcaatcctagtggtaaactacccatcacgttctataagagcaccgaagaattgccagacttcctggattacacgatgaagaaccgtacctatcgctattatacgggcgaggcactgttccccttcggtttcggactgagctacaccacctttgccatctcaaagccagtctataaaaataacaaggtacgtgtgaccgttaagaatactggtgctcgcaagggattggaaaccgtacaggtttatgttaggaacatggcagacaagcagggtccactgaaaactctgaaagcctacaagcaagtagaagtggaggttggcgaaagcaaggtggtagatatcgatttgccccgcaacagctttgagggatgggacgagaagaccaacaccatgcgtgttgtaccaggaaagtacgagctgatggtaggttcgtcgagtgccgataaggatttgaaaaaggtggttgttacagtgaagtaa

SEQ ID NO: 298 - protein, 866 aa, Unknown
  Obtained from environmental sample
  SIGNAL (1)...(18)
  DOMAIN (54)...(308): Glycosyl hydrolase family 3 N terminal domain
  DOMAIN (378)...(757): Glycosyl hydrolase family 3 C terminal domain
  DOMAIN (467)...(611): PA14 domain
  SITE (411)...(414): N-glycosylation site. Prosite id = PS00001
  SITE (419)...(422): N-glycosylation site. Prosite id = PS00001
  SITE (458)...(461): N-glycosylation site. Prosite id = PS00001
  SITE (484)...(487): N-glycosylation site. Prosite id = PS00001
  SITE (520)...(523): N-glycosylation site. Prosite id = PS00001
  SITE (678)...(681): N-glycosylation site. Prosite id = PS00001
  SITE (746)...(749): N-glycosylation site. Prosite id = PS00001
MRKLLTALLVTVAIGANAQMLPYQNPQLTAEQRADDLLGRLTLDEKVKLMMDTSPAIPRLGIPQFQWWNEALHGVGRNGFATVFPITMAMAASWDDALVHKVFTAVSDEARVKAQQAKRSGNIQRYQSLSFWTPNINIFRDPRWGRGQETYGEDPYLTTQMGLAVVRGLQGVGYQGEDLGVSKYRKLLACAKHFAVHSGPEWNRHTFNIENLPERDLWETYLPAFKALVQEGNVAEVMCAYQRIDGQACCAQTRYEQQILRDEWGFDGLITSDCGAIRDFLPKWHNVAKDGAEASAKAVLAGTDVECGSEYKNLPAAIKRGDIKESDLDKSLRRLLIARFELGDFDSDEANAWTKIPESVIASKEHKKLALDMAQKSIVLLKNNGVLPLTQSQPAELVVMGPNANDSVMMWGNYSGYPTRTITALEGINRYFKAQTPTAKVRYIQGCGLTRNESFISRFDKVQGPLGYQGMQAIYWNNTEMKGEPVTTVHIKDPIHLSNGGNTVFAPGVNLENFSARLDGIFKPTEDETLIFDISADDKMRLIVNSDTLVDIWKVRHRIQGDKKELKVKAGEHYRIQIDYVQETGYGALNFDIKKKVNPTQQELLAQIGNAETIIFVGGISPSLEGEEMKVSEPGFKGGDRTSIELPQAQRDMLAMLHKAGKKVVFVNCSGSAMALTPELETCDAIIQWWYAGELGGSALAGVLMGDSNPSGKLPITFYKSTEELPDFLDYTMKNRTYRYYTGEALFPFGFGLSYTTFAISKPVYKNNKVRVTVKNTGARKGLETVQVYVRNMADKQGPLKTLKAYKQVEVEVGESKVVDIDLPRNSFEGWDEKTNTMRVVPGKYELMVGSSSADKDLKKVVVTVK

SEQ ID NO: 299 - DNA, 1014 bp, Unknown
  Obtained from environmental sample
atgacatcaaaacactttttcaaaattacccttatgtcaatacttttattcaccacaacacttgcgcaaaccttttcccaaaccccggttgaattacatggccgtctcagggtttctggcaaccagatcgtggatgagcatggcaatccattacagttgatgggtatgagcctcttctggtcggtttggggtgcagagaaatactacaacgccgatgtggtgaactggctggtaaaagactggaagatcgacctgattcgtgcagcaatagctgttgaggtaaaccaggaaggagatgggaataaaggatggcttttcaacaaagaggggcagtacaaactggccgaaaccattatccaggccgctatcgacaatggcatatatgtcctgatcgattggcacacccatcgtacccataccgatgcagcgattgagtttttcggctacctggcccaaaaatatggcaggtaccccaacctgatctgggaaacattcaacgaaccgataaaccagggctggcaggagatcgctgactttaccaatgcggtaaccggagccattcgcccacacagcgataatctgatcattgcaggtacccgccgctggagccagctggtgaatgagcctgccgacaatccgctcccagataaaaacactgcctattcgctgcacttttatgccggcacccatgggcaggaactccgcgatattggcgactatgcactctcaaaaggaattgcccttttcatcaccgagtggggcacctcccatgccgatggcggccgcgacatgatcgtgcacaaagaaaaagcacaggagtggatcgactgggcagtggagcgtaacctgagtatggccaactggtcactttttgataaggaagaagcttctgcagcactccagcccgaggcacccgtcaacggaaactgggatccggaaaaacacctatcagtatcaggccggtttgtcagagaccagatcatccggatcaataacaaaaagtacaaaaagtag

SEQ ID NO: 300 - protein, 337 aa, Unknown
  Obtained from environmental sample
  SIGNAL (1)...(22)
  DOMAIN (41)...(298): Cellulase (glycosyl hydrolase family 5)
  SITE (162)...(171): Glycosyl hydrolases family 5 signature. Prosite id = PS00659
  SITE (286)...(289): N-glycosylation site. Prosite id = PS00001
  SITE (291)...(294): N-glycosylation site. Prosite id = PS00001
MTSKHFFKITLMSILLFTTTLAQTFSQTPVELHGRLRVSGNQIVDEHGNPLQLMGMSLFWSVWGAEKYYNADVVNWLVKDWKIDLIRAAIAVEVNQEGDGNKGWLFNKEGQYKLAETIIQAAIDNGIYVLIDWHTHRTHTDAAIEFFGYLAQKYGRYPNLIWETFNEPINQGWQEIADFTNAVTGAIRPHSDNLIIAGTRRWSQLVNEPADNPLPDKNTAYSLHFYAGTHGQELRDIGDYALSKGIALFITEWGTSHADGGRDMIVHKEKAQEWIDWAVERNLSMANWSLFDKEEASAALQPEAPVNGNWDPEKHLSVSGRFVRDQIIRINNKKYKK

SEQ ID NO: 301 - DNA, 1374 bp, Unknown
  Obtained from environmental sample
atgtttcaaagtttgaagatgcgtacattatcgttcctgctcctgatggcgttgcttgcttcgtttctggcactacccaccgacgtggcccatgccatcaacacgccctggttgagcgtctcaggcaggttcatcaaggacccggcgggcaataacgtggtcctgcgaggggtctcgctggtggatattggtgaggtgaaccttggacggacgcgcaatgtcagccaggtgatcaatatggctaccaatgaagccgatggctggtatgcgcgtgtagtgcgcctgccagtctatccgaatgcgatcgatagttcgcccggctggctggcaaacccagatgcttatttcaataaccatctcaacccggctattcagaactgtgtggcgcgccagatctactgcatcatcgactggcactatatcgcggactataacaacagcacgatcgacacaaacacacgcgccttctggaactatgtggcaccacgatatgccaatactccgaatgtaatcttcgaattgtacaatgaaccagtcaaccctgataactggtcaacgtggaagcaatgggcgcagccctgggtagacatcatccgctcccatgcgccgaacaacttgatcctgatcggtggtccgcgctggtcgcagaatctttcgagcgcggcgagcagtccatttactggcagtaatcttgtgtatgttgcccacatctatcctgaacacggcggacaaagcaactgggattcatggttcggcaatgccgcgaactctgttcccttctttgtcacggaatggggctggatacagggcggcgccaccccaactaatggcacacagtctggctacggtgttccgttcagtaactaccttgaatcaaagggcttgagttggaccgcctgggtctttgatcaatattgggatcctaaaatgtgggatgagaactggaacctgctcggcggtgagaattacatgggacagttcaccaaagacttcctgttccagcaccgcaacgacaacctgcccggcggcagcgcgaccaacacacctcctggtccaaccttcacgccgacgcgcaccaacacaccgggcagcggcaccctgaaagtgcaggtgtcggctggcggcacggacaacaaccagcagacggccttccgcttccgggtgcagaacaccggttcgagcgcggtctcgaacgtctcgacgcgcctctacttcacactggatggcagcaatgcggcgtcgaactacacattggagaaatattgggatcaatcgggagtcgcaacggtttccggtcccacacaggcgtccggttcgacctattactttaccgtgaactatggcacggcctctctgggggctggcaattcatgg

SEQ ID NO: 302 - protein, 458 aa, Unknown
  Obtained from environmental sample
  DOMAIN (43)...(310): Cellulase (glycosyl hydrolase family 5)
  DOMAIN (369)...(446): Cellulose binding domain
  SITE (74)...(77): N-glycosylation site. Prosite id = PS00001
  SITE (147)...(150): N-glycosylation site. Prosite id = PS00001
  SITE (172)...(181): Glycosyl hydrolases family 5 signature. Prosite id = PS00659
  SITE (185)...(188): N-glycosylation site. Prosite id = PS00001
  SITE (220)...(223): N-glycosylation site. Prosite id = PS00001
  SITE (280)...(283): N-glycosylation site. Prosite id = PS00001
  SITE (395)...(398): N-glycosylation site. Prosite id = PS00001
  SITE (404)...(407): N-glycosylation site. Prosite id = PS00001
  SITE (421)...(424): N-glycosylation site. Prosite id = PS00001
MFQSLKMRTLSFLLLMALLASFLALPTDVAHAINTPWLSVSGRFIKDPAGNNVVLRGVSLVDIGEVNLGRTRNVSQVINMATNEADGWYARVVRLPVYPNAIDSSPGWLANPDAYFNNHLNPAIQNCVARQIYCIIDWHYIADYNNSTIDTNTRAFWNYVAPRYANTPNVIFELYNEPVNPDNWSTWKQWAQPWVDIIRSHAPNNLILIGGPRWSQNLSSAASSPFTGSNLVYVAHIYPEHGGQSNWDSWFGNAANSVPFFVTEWGWIQGGATPTNGTQSGYGVPFSNYLESKGLSWTAWVFDQYWDPKMWDENWNLLGGENYMGQFTKDFLFQHRNDNLPGGSATNTPPGPTFTPTRTNTPGSGTLKVQVSAGGTDNNQQTAFRFRVQNTGSSAVSNVSTRLYFTLDGSNAASNYTLEKYWDQSGVATVSGPTQASGSTYYFTVNYGTASLGAGNSW

SEQ ID NO: 303 - DNA, 2481 bp, Unknown
  Obtained from environmental sample
atggcattgtccaccgtttcaaaagtcatgctgctgacctgtgcagcggtcctgctgaccataccgggatgtaactccgccatggagcagccggaaaaatggccgtatgaggacgtttccgtcacgccggagagctggccgcagctgacggtggcggcgctcgacccggcgatcgaggcgcagattgatgcgatcctgccgaagctgacactggagcagaaggtcgggcaggtgatccagggcgacagcgaattcctgacgccggacgatgtgaaacgataccggttgggatcggtgttgagcggcgggaactcggcgccgggcgagcagccgtttgcggatgcggcgacctggctggcggcggcggatgcgtatttcgaagcatcgctggataccgagggcgtagagatcgccattccggtgatctgggggattgatgccgtacacggacatacgaaccttgtcggcgcgaccgtgtttccgcacaatgtcggccttggcgcgacgaatgatccggagctgatccgggatattgcggcggtgacggcggcagagctggttgtgtccggccatgactggacgttcgccccgacactggccgtgccgcgcgatgaccggtggggccgggcgtatgaaggtttctcggaagacccggaaattgtgcgcaattttgccggaaaggtggtcgaggggctgcagggcgtgcagggcgcggaaggctggctgcgcgaggggcgcgtgatctcgagtgcgaagcatttcgttgccgatggcggcacggagaatggccgcgaccagggcgatgcgcgcatcagcgaagcagagctgcgcgacattcatgcagcgggctatatgccggcaattgagtccggtgtgcagacgatcatggcttctttctccagctggaacggcatcaagatccatggcagccatgctctgctcacggacgttctcaaggatcggctcgggtttaccgggttcattgtcggcgactggaatgcgcatgggcagattccgggatgtacgaacacggattgtccgcaggcactgctggcggggatcgacatgtacatggcgccggacagctggaaggggatgtatgagtcgacgctgaagcatgttcaggacggcaccattccgatggagcggctggatgatgccgtgcggcgcatcctgcgtgtgaagattgcctatggcctgttcgacaagccgaagccgagtctgcgggcgggcgcgggagacacttcgctgctcggctcggcggcgcaccgggatgtggcgcggcgggctgtgcgccagtcgatggtgctgctcaagaacaatgacggcacgctgccgctggcggcgaagcagacggtgctggttgtgggcgacggggccgacagtatcagcaaggtgtcgggcggctggacgctgtcctggcagggcggcgggtatgacaatgcgcattttcccaacgggcagtcgatcctgtcgggcatccgcgaggtggtcgaagcggcaggcggcaccgtgatccacgatccggcgggcacgagcggggccagggcggatgtggtgatcgcggtatacggtgaagatccgtatgcagagttccagggcgaccgggacaatgtggactttgtgccggagggctttgatacggggctgctggcagggtaccgggcaaagggcgcgaaggtggtgtcgttgttcctgtcgggccggcctctgtggaccaacccggaaatcaatgcgtcggatgcgttcgtggccgcgtggtggccaggctctgaaggcggcggcgtggcggacctcttgttccggacgaagccggaatatgacttcacggggcggctttccttctcctggccggcgagcgcggtgcagacgccgctgaaccggggcgacgcgaattatgcaccgcaatttgcctatggttatgggctttcctatgccgcgccgcaggtggtgggtgtactgacggaagagtccgggctggcggcggatgcaaacggcgctcgcggcgcggtgtttgtgcgcgggcaggcggtggcaccgtggagcatgcggttcgaggggtcggacggcccgcccgcgcgggtggatcatggggcgcaggaagatgcgctggcgctttcggcgaacagtgcgccggcgtcgctctccttcgagacggcgggcgccgggcttgactggtcgcgggagtcgaacggggcgatggaactcagcttctttgcgcgctcgatgacggcggagccggcgagcgtgaacgtgtcgatgggatgcgcgctcgagggggcttgtgcgcggcaggtgccggtggcggtcggcgccgagtgggcggagcaccggatttcgctcagctgttttgcggatgccggtgtcgacatgtcaaagctgacgagcgcggttcgcttcgggctggacggcgggcgtgtggcgtttgccggcattgcgctcgccgaggacaaggacggccagccgaactgcggcggctga

SEQ ID NO: 304 - protein, 826 aa, Unknown
  Obtained from environmental sample
  DOMAIN (132)...(359): Glycosyl hydrolase family 3 N terminal domain
  DOMAIN (435)...(647): Glycosyl hydrolase family 3 C terminal domain
  SITE (586)...(589): N-glycosylation site. Prosite id = PS00001
  SITE (762)...(765): N-glycosylation site. Prosite id = PS00001
MALSTVSKVMLLTCAAVLLTIPGCNSAMEQPEKWPYEDVSVTPESWPQLTVAALDPAIEAQIDAILPKLTLEQKVGQVIQGDSEFLTPDDVKRYRLGSVLSGGNSAPGEQPFADAATWLAAADAYFEASLDTEGVEIAIPVIWGIDAVHGHTNLVGATVFPHNVGLGATNDPELIRDIAAVTAAELVVSGHDWTFAPTLAVPRDDRWGRAYEGFSEDPEIVRNFAGKVVEGLQGVQGAEGWLREGRVISSAKHFVADGGTENGRDQGDARISEAELRDIHAAGYMPAIESGVQTIMASFSSWNGIKIHGSHALLTDVLKDRLGFTGFIVGDWNAHGQIPGCTNTDCPQALLAGIDMYMAPDSWKGMYESTLKHVQDGTIPMERLDDAVRRILRVKIAYGLFDKPKPSLRAGAGDTSLLGSAAHRDVARRAVRQSMVLLKNNDGTLPLAAKQTVLVVGDGADSISKVSGGWTLSWQGGGYDNAHFPNGQSILSGIREVVEAAGGTVIHDPAGTSGARADVVIAVYGEDPYAEFQGDRDNVDFVPEGFDTGLLAGYRAKGAKVVSLFLSGRPLWTNPEINASDAFVAAWWPGSEGGGVADLLFRTKPEYDFTGRLSFSWPASAVQTPLNRGDANYAPQFAYGYGLSYAAPQVVGVLTEESGLAADANGARGAVFVRGQAVAPWSMRFEGSDGPPARVDHGAQEDALALSANSAPASLSFETAGAGLDWSRESNGAMELSFFARSMTAEPASVNVSMGCALEGACARQVPVAVGAEWAEHRISLSCFADAGVDMSKLTSAVRFGLDGGRVAFAGIALAEDKDGQPNCGG

SEQ ID NO: 305 - DNA, 1119 bp, Unknown
  Obtained from environmental sample
atggcgatcggaatctcggcgacgatgctgctcgcgatgccccagcaggccgacgggctgaacggcgtccctgcctcgcgcttcgcccacttccagaagggcgtcaacatgagccactggttcagccagtggggcgacctgacccccgcccggttcacctcctacgtgaccgagcgcgacatggacctcatccggcaggccggcttcgaccacgtgcggctgccgttcaacccggacccgttctggaacgatgcggaccccgcgaagatccgccccgttccgctgtcgtactgcaagaaggcggtcgaagggttcctgaagcggggcctcgccgtggtggtggacatgcacccggaggacccgttcaagaaccgcatcgccaccgacgacgcgttcgtggccaaggccgccgccttctggcgcgcgttcgccaaggagatggcctcgttcgacccggagcgggtgatgctcgagatcatgaacgagccctcgatcgacggtcgcggcgccaaggacccggtccgacgctggcaccagatcaacacccagctggccaaggcgatccgcgagggcgcgccgcggcacaccatcgtggccgccggcggaggatggacgggcgtcgaccagttcgacacgctggaaccgatcccgctgcggaacgtggtctacaacttccactgctacgacccgttcgtgttcacacaccagggagcgacctggggatgggacatgtcccgcctgatgaaggccgttccctatccctcttcgccggaggccgtgcaaccggccatcgccgccagcgaccccaaggtccgcgacatcctgatcggctacggcaacgagcggtggaaccgcgcgcgcctgcgctcccacctcaagaaggccgcggactgggctgccaagcaccgcgtgtacctgacctgcaacgagttcggcgtgtacatcccgaacgcaccgcgggagtcgcggctggcatggctgcgcgacatggcctcggtgctgcgggagtaccgcatcggctgggccatgtgggactacgccggcgggttcgcggtggcgctcggcgagccgggcaagcggaccatggaccgggacgtgctgaaggcgctcgggctgtga

SEQ ID NO: 306 - protein, 372 aa, Unknown
  Obtained from environmental sample
  SIGNAL (1)...(17)
  DOMAIN (38)...(354): Cellulase (glycosyl hydrolase family 5)
  SITE (36)...(39): N-glycosylation site. Prosite id = PS00001
  SITE (157)...(166): Glycosyl hydrolases family 5 signature. Prosite id = PS00659
MAIGISATMLLAMPQQADGLNGVPASRFAHFQKGVNMSHWFSQWGDLTPARFTSYVTERDMDLIRQAGFDHVRLPFNPDPFWNDADPAKIRPVPLSYCKKAVEGFLKRGLAVVVDMHPEDPFKNRIATDDAFVAKAAAFWRAFAKEMASFDPERVMLEIMNEPSIDGRGAKDPVRRWHQINTQLAKAIREGAPRHTIVAAGGGWTGVDQFDTLEPIPLRNVVYNFHCYDPFVFTHQGATWGWDMSRLMKAVPYPSSPEAVQPAIAASDPKVRDILIGYGNERWNRARLRSHLKKAADWAAKHRVYLTCNEFGVYIPNAPRESRLAWLRDMASVLREYRIGWAMWDYAGGFAVALGEPGKRTMDRDVLKALGL

SEQ ID NO: 307 - DNA, 2820 bp, Unknown
  Obtained from environmental sample
atgtcctgccgcaccctgatgagtaggcgtgtaggatggggacttttattgtggggaggtttattcctcagaaccggttcggttacaggacaaacttacaattatgccgaagtcctgcagaaatctatgtttttctacgaatgtcaggagtctaaaattgccccgggcaatcgggtgacatggcgagctaatgcagccatgaacgatgggagcgatgttggaaaagacctgacaggaggatggtttgatgcaggtgaccatgtgaaatttaattttcccatggcgtttaccgctacggcgctggcgtggggagctattgactttgctcagggatacattagttccgggcaaatgcaatacctgaaacgtaatctgcgctacgtcaatgactatttcattaaatgtcacacagcccccaacgaattgtatggtcaggtgggtaatggaggccttgaccatgccttttggggaccacccgaagtcatgcgcatggctaggcctgcctataaaattgatgcgtcaaaacccggatcagatctggctgccgaaacagctgctgcaatggctgccgccagcattgttttcaaatccgacgatcctacctatagcgctactttgctgaatcatgcaaaacagctgttttcttttgccgaaacctataaaggaaaatattccgacgctattaccgatgctgcaggatattataactcctggagcggctataacgatgaactggtatggggagctatatggctttaccgggctaccggcgatgcaacctatctatctaaggcagaatcctattacgacaatctgggtaatcagggtcaggaacccgttaaagcctacaaatggaccattgcatgggatgacaaatcctatggctgttatgccctactggccaaattgacaggtaaggaaaaatacaaaattgacgccgaacgttttctcgactattggaccgatggttataatggttcccggattacttataccccgggaggactcgctttcctcgatatatggggatcgttgcgctatgctatgaatactgcctttgttgctgcctactatgccgatgcagccacttcagctgctaaaaccacaaaatatctcaactttgctaaacaacaactgcattatgctcttggatccaatccgagcaacagaagctatgtctgtggctttggcaataatcctcccgttaatcctcaccatagaggtgcacacggagcatggtctaataatgttcaaggacctcctaccgaaacacgacatatcctctacggcgcattagtgggtggaccaggcagtaatgactcctatactgacgaccgatccaattacaccaataacgaagtagcatgtgactacaatgctcttttctccggactgcttgcaaagttcgtcattgattatggaggcacaccgttagccaacttccctgttcgtgaaaccccaaaagatgaatatttcgttgaagcaaaagcaaacgctacaggaaccaatttctccgaatggacggtatgggtatacaaccacactgcatggccagcccgtgaaggttctgaatataaattcagattatacgtaaatatttcggaaggactggctgcaggctatactgcctcaaattatgttgtgcaaaccaataatgccggtgtggtaaactttacccaacttttagctgctgatgcagctaacggcatctattataccgaagtaacctttaaacctggtaccgaaatttatcctggcgggcaacagtatgacaagaaggaagctcagatgcgtattagtttgcccaatgctccggcttctgcatgggatccgactaacgacccgtcatgggcgggaatcacctctaccttgaaacaaatgccgggtatacccatgtatgtagatggtgtaaaggtatttggtaatgagcctgtcccaggtcagacagttcccgtcaccggagtaaccgtatcgcctaccaccctgagtctgactgtaggacagaccagtacactcaccgctaccgtatcgccggctaatgctaccaacaaaaacgtcacctggagcagcagcaataccagcgtagccacggtaagctcaacaggcgttgtcacagccgtagcagccggttcggccaccatcaccgtaaccacagtcgatggcgctaaaacagccacctgcgccgtaacggtaacaggcagcaccaacgttcccgtcaccggagtaaccgtatcgcccaccacgctgagtctgaccgtagggcagaccgctaccctcaccgctaccgtatcgccggctaatgctaccaacaagaacgttacctggagcagcagcaataccagcgtagccacggtaagttcaacaggcgtagttactgccgtagcggccggttcggccaccatcaccgtaaccaccgtcgatggagctaaaaccgctacctgcaccgtaacggtaacgggcagcactaccgtacccgtcaccggcgtaactgtatcgcctaccaccctgagtctgaccgttggacaaaccgctaccctgaccgctaccgtatcgccagctgatgctaccaacaagaacgtcacctggagcagcagcaataccagcgtagccacggtaagctcaacaggcgtagtcactgccgtagcggccggttcagctaccatcaccgtgaccacagtcgatggggctaaaactgctacctgtgccgtgaccgtaaccgccggaggttccaccaccccctgcagtaatccggtaagcaaaaccctacctctggtacaggatggtgccggcgaattcaggttgagtaatagttttaattaa

SEQ ID NO: 308 - protein, 939 aa, Unknown
  Obtained from environmental sample
  SIGNAL (1)...(30)
  DOMAIN (34)...(469): Glycosyl hydrolase family 9
  DOMAIN (491)...(576): Cellulose binding domain
  DOMAIN (651)...(729): Bacterial Ig-like domain (group 2)
  DOMAIN (738)...(816): Bacterial Ig-like domain (group 2)
  DOMAIN (825)...(903): Bacterial Ig-like domain (group 2)
  SITE (445)...(448): N-glycosylation site. Prosite id = PS00001
  SITE (454)...(457): N-glycosylation site. Prosite id = PS00001
  SITE (505)...(508): N-glycosylation site. Prosite id = PS00001
  SITE (510)...(513): N-glycosylation site. Prosite id = PS00001
  SITE (520)...(523): N-glycosylation site. Prosite id = PS00001
  SITE (540)...(543): N-glycosylation site. Prosite id = PS00001
  SITE (565)...(568): N-glycosylation site. Prosite id = PS00001
  SITE (690)...(693): N-glycosylation site. Prosite id = PS00001
  SITE (695)...(698): N-glycosylation site. Prosite id = PS00001
  SITE (702)...(705): N-glycosylation site. Prosite id = PS00001
  SITE (778)...(781): N-glycosylation site. Prosite id = PS00001
  SITE (783)...(786): N-glycosylation site. Prosite id = PS00001
  SITE (872)...(875): N-glycosylation site. Prosite id = PS00001
  SITE (879)...(882): N-glycosylation site. Prosite id = PS00001
MSCRTLMSRRVGWGLLLWGGLFLRTGSVTGQTYNYAEVLQKSMFFYECQESKIAPGNRVTWRANAAMNDGSDVGKDLTGGWFDAGDHVKFNFPMAFTATALAWGAIDFAQGYISSGQMQYLKRNLRYVNDYFIKCHTAPNELYGQVGNGGLDHAFWGPPEVMRMARPAYKIDASKPGSDLAAETAAAMAAASIVFKSDDPTYSATLLNHAKQLFSFAETYKGKYSDAITDAAGYYNSWSGYNDELVWGAIWLYRATGDATYLSKAESYYDNLGNQGQEPVKAYKWTIAWDDKSYGCYALLAKLTGKEKYKIDAERFLDYWTDGYNGSRITYTPGGLAFLDIWGSLRYAMNTAFVAAYYADAATSAAKTTKYLNFAKQQLHYALGSNPSNRSYVCGFGNNPPVNPHHRGAHGAWSNNVQGPPTETRHILYGALVGGPGSNDSYTDDRSNYTNNEVACDYNALFSGLLAKFVIDYGGTPLANFPVRETPKDEYFVEAKANATGTNFSEWTVWVYNHTAWPAREGSEYKFRLYVNISEGLAAGYTASNYVVQTNNAGVVNFTQLLAADAANGIYYTEVTFKPGTEIYPGGQQYDKKEAQMRISLPNAPASAWDPTNDPSWAGITSTLKQMPGIPMYVDGVKVFGNEPVPGQTVPVTGVTVSPTTLSLTVGQTSTLTATVSPANATNKNVTWSSSNTSVATVSSTGVVTAVAAGSATITVTTVDGAKTATCAVTVTGSTNVPVTGVTVSPTTLSLTVGQTATLTATVSPANATNKNVTWSSSNTSVATVSSTGVVTAVAAGSATITVTTVDGAKTATCTVTVTGSTTVPVTGVTVSPTTLSLTVGQTATLTATVSPADATNKNVTWSSSNTSVATVSSTGVVTAVAAGSATITVTTVDGAKTATCAVTVTAGGSTTPCSNPVSKTLPLVQDGAGEFRLSNSFN

SEQ ID NO: 309 - DNA, 1725 bp, Unknown
  Obtained from environmental sample
atgctgaaattaagtgataacctaactttcttgaaaagcaaaccattttttcttaatgaaaaagaaatgaagtgggtggagaaaacacttcaatccatgtccttacatgaaaaagtagggcaattattttgtcccattggcggttcagataataaacaagaattagaagcctttattaaggaatatcatcctggcggcatcatgtaccgtcctaatacaggagcaaaaatacaggaaacacatcggttgttacaagagctatccccggtacctttattaatttctgctaacttagaggccggtggtaatgggattgctacggatggtacttacttcggaaagcaaatgcaggtggctgcaacagataatgaagaaatggcctataaattaggattagttgctggccgtgaaggccgtgtggccggttgtaactgggcttttgcaccaattgttgatattgatatgaactatcgaaacccaattacaaacgtaagaacgtatgggtctgacccaattagagttgcccaaatgtctaaagcttttatgaagggaattcatgaaagcggactcgcagcagctgttaagcatttcccaggggatggagtggatgatagagatcagcatcttttatcatctgtaaacaccttatctaccgaagaatgggatcaaacctttgggatggtttatcaagaaatgatagacagtggggcaaaatcgattatggcgggccatatcatgctccctgaatattcaagagaactattgccgggtattgaagacgaacaaatcatgcccgccacactagcaccagagttacttaatggtttattaagggaaaagttaggttttaatggtttaatcgtgactgatgcatcccctatgttagggttcactacttcggaaagaagagaaattgctgttcctaaggcgattgcttcgggctgtgatatgtttctcttcaaccgtaacataaaagaagattatgagttcatgctgaatggaattgaaactggaattctaaccttggaaagagtagatgaagctgttactagagtacttgctcttaaagcatctctaggtctgaatgtacaaaaggaattgggaatattagtacctgaagaagcggaattgtcggtattacaatctgaagaacatttggattgggcaagagaatgtgcagaccaatcggttacattagtaaaggatacacaaaaactgctgcctattagtgctgatcagtataaacgggttcgactttatgtattgggtgatcaagaaggagggctaaaggaaggcggctccgtcactcaaccgtttatcgattctcttaaaaatgctggctttgaagtagatttatataatgacaagcaagttaatttccaagaactgtttatgagtgtaaacgagtttaaaaagaactatgatctgatcatttatgtcgccaaccttgaaaccgctagtaaccaaacgacagtcagaattaattggcagcagccgctaaatgccaacgctccatggtttgttaaagatataccgacattatttatttcggttgctaacccataccatctacaggacgtaccaatggttaagacctatataaatgcttattcatctaatgaatatgtggtagaagcaattgtagataaaatcttaggaaaatcagagtttaaagggaagaatcccgtcgatccgttttgtgggaaatgggataccagactttaa

SEQ ID NO: 310 - protein, 574 aa, Unknown
  Obtained from environmental sample
  DOMAIN (87)...(320): Glycosyl hydrolase family 3 N terminal domain
  SITE (7)...(10): N-glycosylation site. Prosite id = PS00001
  SITE (495)...(498): N-glycosylation site. Prosite id = PS00001
MLKLSDNLTFLKSKPFFLNEKEMKWVEKTLQSMSLHEKVGQLFCPIGGSDNKQELEAFIKEYHPGGIMYRPNTGAKIQETHRLLQELSPVPLLISANLEAGGNGIATDGTYFGKQMQVAATDNEEMAYKLGLVAGREGRVAGCNWAFAPIVDIDMNYRNPITNVRTYGSDPIRVAQMSKAFMKGIHESGLAAAVKHFPGDGVDDRDQHLLSSVNTLSTEEWDQTFGMVYQEMIDSGAKSIMAGHIMLPEYSRELLPGIEDEQIMPATLAPELLNGLLREKLGFNGLIVTDASPMLGFTTSERREIAVPKAIASGCDMFLFNRNIKEDYEFMLNGIETGILTLERVDEAVTRVLALKASLGLNVQKELGILVPEEAELSVLQSEEHLDWARECADQSVTLVKDTQKLLPISADQYKRVRLYVLGDQEGGLKEGGSVTQPFIDSLKNAGFEVDLYNDKQVNFQELFMSVNEFKKNYDLIIYVANLETASNQTTVRINWQQPLNANAPWFVKDIPTLFISVANPYHLQDVPMVKTYINAYSSNEYVVEAIVDKILGKSEFKGKNPVDPFCGKWDTRL

SEQ ID NO: 311 - DNA, 2298 bp, Unknown
  Obtained from environmental sample
atgatcaatcaagatataaaacaattaatctcacaaatgaccttggaagaaaaagctggtctttgttctggattagatttttggaatttaaaaggtatcgaaagactgggaataccctcgataatggtaaccgatggtccgcatggactccgtaaacaaaaaatgggagcagatcatttagggctgtttgacagtattcctgcgacatgtttcccatctgcagccggtttagctagtacttggaataaagagttaatatatgaagttggggttgcattaggaaaggaatgccaggcagaggatgtggcaatacttcttggccctggagcaaacattaagcgctcacccctttgtggcagaaactttgaatatttttcggaagatccattcctttcatcagaaatggctgcgtcccatatcaagggtgttcaaagtgagggggttgggacatcacttaagcacttcgctgcaaataatcaagaacaccgaagaatgtcgacagatgctattgtggatgaaaggacgttgcgagaaatatatttggccagctttgaaaacgctgtaaagaaagcgcagccatggactgtgatgtgcgcctacaacaaggtcaatggagactttgcatcagaaaataaaacattgttaactgacatcctgcgagatgagtggggctttgaaggaattgttgtttctgactggggggcggttaatgaacctgttgacggattaaatgccgggttagacctggaaatgccttcaagtagtgggattggtgaaaagaaaatcatcaatgctgtaagaaatggtcagcttttagaagataaactagatcaggcagttgaaagaattctacgtattatcttaatggcagtagaaaacaagaaagaaaccgctgactatgataaagaacaacatcataagcttgcaagaaaagcagcaagtgaaagtatggttttattaaagaatgaagataatatcctgccgttaaagaaagaaggaaccatttcgattattggttcatttgccaaaaaaccaaggtatcaaggcggtggaagctcacacattaacccgacaaagcttgaaaatatctatgaagaaatagagaaaacagcgggccaaaatgtgaacgttttatacgcggaaggatatcatcttgaaaaggatttaatcgatgatcaattaattgaagaggcaaaaaaaacggcagcaaaatccgatgtaaccgtattgtttgtaggtcttcctgaccgatatgaatctgaaggatatgatagagagcacctgaatataccggagaatcaccgtcttttagtcgaagcggttgcggaagtacaaaagaatatagttgttgtactaagtaatggggcaccgcttgttatgccatggcttgataaggtgaaggggctgctggaaagttacctgggaggtcaggcactaggaggtgcgattgcagacatcctattcggagaagttaatccaagtggaaagcttgccgaaacttttcccgtaaaattaggtgacaatccttcttatctcaactttccaggagagagggataaagttgagtataaagaaggcatctttgttggttatcgttattacgatacaaaacagattgagccgctgtttccatttggatatggtttaagctatacaaactttgaatataaaaaccttgtaattgataaaaaagaaataaaagatacagaaattgtcacagttaccgtgaatgtgaaaaatacaggaaaagtgcctgggaaagaaatcatccagttatatgtaaaagatataaaaagcagtgtagttcgtcctgaaaaagagttaaaaggctttggaaaggtttccttacagcctggggaagacaaaactatttcctttaaattggataaacgcgcatttgcatattacaacacggaattgaaggattggtatgtagaatcaggagaatttgaaattttggtggggaaatcgtccagagaaattgaactaacagaaaaaattatggttcactctacttccccagttttcttggaggttcaccgaaattccacggtcggagatcttttaactgatccaattctaggtgaaaaagctaatgctctaattagagagctaacaaaaggaagtccattatttgatgctgggtcagatcacggagagggtgcagaaatgatggaagcgatgttaaaatacatgcctttgcgtgctcttatgaattttagtggtggagacattaccgaagagaaactaactgaatttattaaggaacttaattcaactaattttgtaagcctttaa

SEQ ID NO: 312 - protein, 765 aa, Unknown
  Obtained from environmental sample
  DOMAIN (30)...(252): Glycosyl hydrolase family 3 N terminal domain
  DOMAIN (317)...(531): Glycosyl hydrolase family 3 C terminal domain
  SITE (214)...(217): N-glycosylation site. Prosite id = PS00001
  SITE (221)...(238): Glycosyl hydrolases family 3 active site. Prosite id = PS00775
  SITE (692)...(695): N-glycosylation site. Prosite id = PS00001
  SITE (750)...(753): N-glycosylation site. Prosite id = PS00001
  SITE (769)...(772): N-glycosylation site. Prosite id = PS00001
MINQDIKQLISQMTLEEKAGLCSGLDFWNLKGIERLGIPSIMVTDGPHGLRKQKMGADHLGLFDSIPATCFPSAAGLASTWNKELIYEVGVALGKECQAEDVAILLGPGANIKRSPLCGRNFEYFSEDPFLSSEMAASHIKGVQSEGVGTSLKHFAANNQEHRRMSTDAIVDERTLREIYLASFENAVKKAQPWTVMCAYNKVNGDFASENKTLLTDILRDEWGFEGIVVSDWGAVNEPVDGLNAGLDLEMPSSSGIGEKKIINAVRNGQLLEDKLDQAVERILRIILMAVENKKETADYDKEQHHKLARKAASESMVLLKNEDNILPLKKEGTISIIGSFAKKPRYQGGGSSHINPTKLENIYEEIEKTAGQNVNVLYAEGYHLEKDLIDDQLIEEAKKTAAKSDVTVLFVGLPDRYESEGYDREHLNIPENHRLLVEAVAEVQKNIVVVLSNGAPLVMPWLDKVKGLLESYLGGQALGGAIADILFGEVNPSGKLAETFPVKLGDNPSYLNFPGERDKVEYKEGIFVGYRYYDTKQIEPLFPFGYGLSYTNFEYKNLVIDKKEIKDTEIVTVTVNVKNTGKVPGKEIIQLYVKDIKSSVVRPEKELKGFGKVSLQPGEDKTISFKLDKRAFAYYNTELKDWYVESGEFEILVGKSSREIELTEKIMVHSTSPVFLEVHRNSTVGDLLTDPILGEKANALIRELTKGSPLFDAGSDHGEGAEMMEAMLKYMPLRALMNFSGGDITEEKLTEFIKELNSTNFVSL

SEQ ID NO: 313 - DNA, 2166 bp, Unknown
  Obtained from environmental sample
atgaagaccaaggctgtagtgctctctctactcctgctgctctccatgttcggtcccatgggggcagagagagcctatggaactactgactctacccaggggcctggagtttactacaaggttgttggggataccatatacatggtaaacctcagcagtggaactgagaagccaatacacctttacggcgtcaactggttcggttttgaaacgcccaaccatgtcgttcatggattatggtcgaggaactgggtggacatgctccagcagataaagtccctcggctttaacgccatcaggcttcccttctgccccgcgtcccttgacccgtcaatctatcccacgggcatcgactactctaagaaccccgacctcaagggactttccagcccggagataatggaaaggatcattaagaaggccggcgatctgggaatcttcgtcctcctcgactttcacaggattggatgcaactacatagaacccctctggtatactgactccttcagcgagcaggactacatagacacgtgggtgagagttgccaagaagtttggaaagtactggaacgtcataggggcggacatcaaaaacgagccccacagtgagagccaggttccgtccgcatataccgacggtaagggtgcaacctggggtatgggtaacgaggcaacggactggaacctcgccgctgagaggattggaagggcaatcctacaggttgcaccccactggttgatattcgtcgagggaacccagtttacgaaccctgaaactgacggggcctacaagtggggctacaacgcgtggtggggcggaaaccttatggcggtcagggattacccgataaaccttccacgggagaaactcgtctacagcccacacgtctatgggcctgacgtttacaaccagccctatttcaacgaagacgacttcccaaacaacatgcctgacatctggtaccaccacttcggctacgtgaagaccgacctcggctatccggttgtcataggggaattcgggggaaaatacggccacggtggaagcgacaaggatccggtatggcagaaggccctagttgactggatgataaagaacaatttctgcgacttcttctactggagctggaatccgaacagcggagacaccggaggaattctccaagatgactggactcacatatgggatgataagtacaggaacctgaagaggttgatggatcactgttctggaagcgactcttccagctccccgtcgggagataccggctctggaaactcgacgccttcctctaacgatacttccagtgaaccaaacgcctccaacttcaatgtgatcaaactcctgccaacatcatcccagtatgagggggcttcatccacggtgacctgtgacggaacgaagtgttcctccagcgtctggggaactccgaacctctggggcgttgtccagataggaaacgcgagcatcgacccgaacgtctggggctgggaggatctctatcagaccgatccagagaaaataggaaccggaacctcaaagatgtggattgaaaagggaattcttcacgtggacaaccgctggacgataaagaccagtcccttgtacaacgttatggcctacaacgaggttatctacggaagcaaaccctgggggaaccagccggtgaacgctcccggctttgaacttccgatggactttaattctctcccgaggatactcgttggcgtgaactacaccctgacgaagggaattccaggcaacaacttcgccttcgaggcatggctcttcaaggacaccaacagcaaccgcgcccccggtgaaggcgactacgagataatggttcagctctacatcaaaaacggctttccggccggttacgaacacggacccgtcgctacctttaacgttccgatggtagtcaacggcaccctgataaaccagacctttgagctttacgacgttgtcgccgatcccggctggaggttcctgacgtttaaatcaaccaaaaactacgtcaacgcgagcgttgtttttgactacacccacttcatcgagatggccaacgactatctaaacgactcgctgaacagtacttacctcatgtccttggagtttggaaccgagatccaaagaattcaaaaagcttctcgagagtacttctag

SEQ ID NO: 314 - protein, 721 aa, Unknown
  Obtained from environmental sample
  SIGNAL (1)...(25)
  DOMAIN (49)...(384): Cellulase (glycosyl hydrolase family 5)
  DOMAIN (559)...(714): Glycosyl hydrolase family 12
  SITE (50)...(53): N-glycosylation site. Prosite id = PS00001
  SITE (438)...(441): N-glycosylation site. Prosite id = PS00001
  SITE (445)...(448): N-glycosylation site. Prosite id = PS00001
  SITE (494)...(497): N-glycosylation site. Prosite id = PS00001
  SITE (586)...(589): N-glycosylation site. Prosite id = PS00001
  SITE (651)...(654): N-glycosylation site. Prosite id = PS00001
  SITE (656)...(659): N-glycosylation site. Prosite id = PS00001
  SITE (684)...(687): N-glycosylation site. Prosite id = PS00001
  SITE (703)...(706): N-glycosylation site. Prosite id = PS00001
  SITE (707)...(710): N-glycosylation site. Prosite id = PS00001
MKTKAVVLSLLLLLSMFGPMGAERAYGTTDSTQGPGVYYKVVGDTIYMVNLSSGTEKPIHLYGVNWFGFETPNHVVHGLWSRNWVDMLQQIKSLGFNAIRLPFCPASLDPSIYPTGIDYSKNPDLKGLSSPEIMERIIKKAGDLGIFVLLDFHRIGCNYIEPLWYTDSFSEQDYIDTWVRVAKKFGKYWNVIGADIKNEPHSESQVPSAYTDGKGATWGMGNEATDWNLAAERIGRAILQVAPHWLIFVEGTQFTNPETDGAYKWGYNAWWGGNLMAVRDYPINLPREKLVYSPHVYGPDVYNQPYFNEDDFPNNMPDIWYHHFGYVKTDLGYPVVIGEFGGKYGHGGSDKDPVWQKALVDWMIKNNFCDFFYWSWNPNSGDTGGILQDDWTHIWDDKYRNLKRLMDHCSGSDSSSSPSGDTGSGNSTPSSNDTSSEPNASNFNVIKLLPTSSQYEGASSTVTCDGTKCSSSVWGTPNLWGVVQIGNASIDPNVWGWEDLYQTDPEKIGTGTSKMWIEKGILHVDNRWTIKTSPLYNVMAYNEVIYGSKPWGNQPVNAPGFELPMDFNSLPRILVGVNYTLTKGIPGNNFAFEAWLFKDTNSNRAPGEGDYEIMVQLYIKNGFPAGYEHGPVATFNVPMVVNGTLINQTFELYDVVADPGWRFLTFKSTKNYVNASVVFDYTHFIEMANDYLNDSLNSTYLMSLEFGTEIQRIQKASREYF

SEQ ID NO: 315 - DNA, 1032 bp, Clostridium thermocellum
atggtgagttttaaagcaggtataaatttaggcggatggatatcacaatatcaagttttcagcaaagagcatttcgatacattcattacggagaaggacattgaaactattgcagaagcagggtttgaccatgtcagactgccttttgattatccaattatcgagtctgatgacaatgtgggagaatataaagaagatgggctttcttatattgaccggtgccttgagtggtgtaaaaaatacaatttggggcttgtgttggatatgcatcacgctcccgggtaccgctttcaagattttaagacaagcaccttgtttgaagatccgaaccagcaaaagagatttgttgacatatggagatttttagccaagcgttacataaatgaacgggaacatattgcctttgaactgttaaatgaagttgttgagcctgacagtacccgctggaacaagttgatgcttgagtgtgtaaaagcaatcagggaaattgattccaccaggtggctttacattgggggcaataactataacagtcctgatgagcttaaaaaccttgcagatattgatgatgattacatagtttacaatttccatttttacaatccttttttctttacgcatcagaaagcccactggtcggaaagtgccatggcgtacaacaggactgtaaaatatccgggacaatatgagggaattgaagagtttgtgaaaaataatcctaagtacagttttatgatggaattgaataacctgaagctgaataaagagcttttgcgcaaagatttaaaaccagcaattgagttcagggaaaagaaaaaatgcaaactatattgcggggagtttggcgtaattgccattgctgacctggagtccaggataaaatggcatgaagattatataagtcttctagaggagtatgatatcggcggcgcggtgtggaactacaaaaaaatggattttgaaatttataatgaggatagaaaacctgtctcgcaagaattggtaaatatactggcgagaagaaaaacttga

SEQ ID NO: 316 - protein, 343 aa, Clostridium thermocellum
  DOMAIN (1)...(323): Cellulase (glycosyl hydrolase family 5)
  SITE (15)...(32): Cytosolic fatty-acid binding proteins signature. Prosite id = PS00214
  SITE (135)...(144): Glycosyl hydrolases family 5 signature. Prosite id = PS00659
  SITE (223)...(226): N-glycosylation site. Prosite id = PS00001
MVSFKAGINLGGWISQYQVFSKEHFDTFITEKDIETIAEAGFDHVRLPFDYPIIESDDNVGEYKEDGLSYIDRCLEWCKKYNLGLVLDMHHAPGYRFQDFKTSTLFEDPNQQKRFVDIWRFLAKRYINEREHIAFELLNEVVEPDSTRWNKLMLECVKAIREIDSTRWLYIGGNNYNSPDELKNLADIDDDYIVYNFHFYNPFFFTHQKAHWSESAMAYNRTVKYPGQYEGIEEFVKNNPKYSFMMELNNLKLNKELLRKDLKPAIEFREKKKCKLYCGEFGVIAIADLESRIKWHEDYISLLEEYDIGGAVWNYKKMDFEIYNEDRKPVSQELVNILARRKT

SEQ ID NO: 317 - DNA, 1374 bp, Unknown
  Obtained from environmental sample
atgaggggatctctcagagctatgctagattacagcgataaggcagaactaggacagcctttaagtaatactagtatacagctagatagcttgcctgtatactatgaggttagaggagacactatttacatgatcaacatgacaaacggtgaggagaaaccgatccacttgttcggagtaaactggtttgggtttgagactccagatcatgttgtccatgggctctgggctagaaactgggaggacatgttaatccaaataaagagcctcggatttaacgctataaggctgccattctgcacagagtcagtgcagcccggaactatgcccgcaacaatagactatagtaagaatccagacctccaggggcttactagcttggaaataatggagaagatcgttcagaaagccggggaactaggcatattcatcctattagactatcatagaataggatgccaatacatcgagccattatggtacactgatacgttcaccgagcaagattatataaacacttggataagcgttgcagagaggttcggaaagtattggaatgttataggagcggatctaaaaaacgagcctcatagcattagtcagcctccaggagcctataccgatggtacaggcgccacctgggggatgggcaataacgctacagactggaatctggcggctgagaggatcggaagggctatactagaagtagctccccactggctgatattcgttgagggaacacagtacacgaggcccgacatcgacggctcctaccagtggggctataatgcatggtggggcggcaatttgatggctgtcagagactacccggttaacctgccaaggaataagctggtatacagcccccacgtctatgggcctgacgtctacgaccagccgtacttcagcgatccaaacttccccaacaacatgccagacatctggtaccatcacttcggctacgttaagatagacctgggatacccggtagtcataggagagtttggaggaagatacggtcatggcggcgatcctagagacgtcgcctggcagaacaagatagttgactggatgatagagaacaacttctgcagcttcttctactggagctggaaccctaacagtggcgatacaggaggcatactacaagacgactggacaaacatatggcaggataaatatgacaatctgaagaggcttatggaccactgctcggcgcagcaagggttgccggatgtatatctctccgtcaacgccacgacggtaagtcccggggatccaaagaattcaaaaagcttctcgagagtacttctagagcggccgcgggcccatcgattttccacccgggtggggtaccaggtaagtgtaccc

SEQ ID NO: 318 - protein, 458 aa, Unknown
  Obtained from environmental sample
  DOMAIN (45)...(380): Cellulase (glycosyl hydrolase family 5)
  SITE (23)...(26): N-glycosylation site. Prosite id = PS00001
  SITE (46)...(49): N-glycosylation site. Prosite id = PS00001
  SITE (222)...(225): N-glycosylation site. Prosite id = PS00001
  SITE (425)...(428): N-glycosylation site. Prosite id = PS00001
MRGSLRAMLDYSDKAELGQPLSNTSIQLDSLPVYYEVRGDTIYMINMTNGEEKPIHLFGVNWFGFETPDHVVHGLWARNWEDMLIQIKSLGFNAIRLPFCTESVQPGTMPATIDYSKNPDLQGLTSLEIMEKIVQKAGELGIFILLDYHRIGCQYIEPLWYTDTFTEQDYINTWISVAERFGKYWNVIGADLKNEPHSISQPPGAYTDGTGATWGMGNNATDWNLAAERIGRAILEVAPHWLIFVEGTQYTRPDIDGSYQWGYNAWWGGNLMAVRDYPVNLPRNKLVYSPHVYGPDVYDQPYFSDPNFPNNMPDIWYHHFGYVKIDLGYPVVIGEFGGRYGHGGDPRDVAWQNKIVDWMIENNFCSFFYWSWNPNSGDTGGILQDDWTNIWQDKYDNLKRLMDHCSAQQGLPDVYLSVNATTVSPGDPKNSKSFSRVLLERPRAHRFSTRVGYQVSVP

SEQ ID NO: 319 - DNA, 1347 bp, Clostridium thermocellum
atgtcaaagataactttcccaaaagatttcatatggggttctgcaacagcagcatatcagattgaaggtgcatacaacgaagacggcaaaggtgaatctatatgggaccgtttttcccacacgccaggaaatatagcagacggacataccggcgatgttgcatgcgaccactatcatcgttatgaagaagatatcaaaataatgaaagaaatcggtattaaatcatacaggttttccatctcatggcccagaatctttcctgaaggaacaggtaaattaaatcaaaagggactggatttttacaaaaggctcacaaatctgcttctggaaaacggaattatgcctgcaatcactctttatcactgggaccttccccaaaagcttcaggataaaggcggatggaaaaaccgggacaccaccgattattttacagaatactctgaagtaatatttaaaaatctcggagatatcgttccaatatggtttactcacaatgaacccggtgttgtttctttgcttggccactttttaggaattcatgcccctgggataaaagacctccgcacttcattggaagtctcgcacaatcttcttttgtcccacggcaaggccgtgaaactgtttagagaaatgaatattgacgcccaaattggaatagctctcaatttatcttaccattatcccgcatccgaaaaagctgaggatattgaagcagcggaattgtcattttctctggcgggaaggtggtatctggatcctgtgctaaaaggccggtatcctgaaaacgcattgaaactttataaaaagaagggtattgagctttctttccctgaagatgacctgaaacttatcagtcagccaatagacttcatagcattcaacaattattcttcggaatttataaaatatgatccgtccagtgagtcaggtttttcacctgcaaactccatattagaaaagttcgaaaaaacagatatgggctggatcatatatcctgaaggcttgtatgatctgcttatgctccttgacagggattatggaaagccaaacattgttatcagcgaaaacggagccgccttcaaagatgaaataggtagcaacggaaagatagaagacacaaagagaatccaatatcttaaagattatctgacccaggctcacagggcaattcaggacggtgtaaacttaaaagcatactacttgtggtcgcttttggacaactttgaatgggcttacgggtacaacaagagattcggaatcgttcacgtaaattttgatacgttggaaagaaaaataaaggatagcggctactggtacaaagaagtaatcaaaaacaacggtttttaa

SEQ ID NO: 320 - protein, 448 aa, Clostridium thermocellum
  DOMAIN (2)...(448): Glycosyl hydrolase family 1
  SITE (10)...(24): Glycosyl hydrolases family 1 N-terminal signature. Prosite id = PS00653
  SITE (225)...(228): N-glycosylation site. Prosite id = PS00001
  SITE (299)...(302): N-glycosylation site. Prosite id = PS00001
  SITE (356)...(364): Glycosyl hydrolases family 1 active site. Prosite id = PS00572
MSKITFPKDFIWGSATAAYQIEGAYNEDGKGESIWDRFSHTPGNIADGHTGDVACDHYHRYEEDIKIMKEIGIKSYRFSISWPRIFPEGTGKLNQKGLDFYKRLTNLLLENGIMPAITLYHWDLPQKLQDKGGWKNRDTTDYFTEYSEVIFKNLGDIVPIWFTHNEPGVVSLLGHFLGIHAPGIKDLRTSLEVSHNLLLSHGKAVKLFREMNIDAQIGIALNLSYHYPASEKAEDIEAAELSFSLAGRWYLDPVLKGRYPENALKLYKKKGIELSFPEDDLKLISQPIDFIAFNNYSSEFIKYDPSSESGFSPANSILEKFEKTDMGWIIYPEGLYDLLMLLDRDYGKPNIVISENGAAFKDEIGSNGKIEDTKRIQYLKDYLTQAHRAIQDGVNLKAYYLWSLLDNFEWAYGYNKRFGIVHVNFDTLERKIKDSGYWYKEVIKNNGF

SEQ ID NO: 321 - DNA, 1362 bp, Unknown
  Obtained from environmental sample
atggcaaacaagataacctttcctgaaaattttctgtggggcgcggcaacggcttcgtaccagatcgaaggcgcctggaacaaacatggtaaaggcgaatccacctgggatcgcttttcacacacgcccggtaagatcaggaacaacgatacgggcgatgtagcaaatgaccattatcgcctctggaaaaaagacattggcttgatgaagaagatcgggttgaaggcttatcgattttccatttcgtggccgcgtattcttcctgctggaagaggcaaggtcaatcaaagagggctggatttttacaacaagatcgtagatgagctgctgaaagcagatatcatcccatttgttactctcaatcactgggacctgccccaaaaactggaagatgagggcggctggccggcccgttctactgccgatgcttttattgaatacacagatgtgatcacccgctcccttggcgaccgcgcaaagaattggatcactcacaatgaacctgccgtcgttgcctggatgggatactccactggccaacacgcacccggactgaaggactatgggcttggtgcccgcgccgcgcatcacctgttgctctcacatggacaggctgtaccggtcattcgcagcaatagcgcgggggcagaagtgggaattacgctcgatattagctggcggatcgctgcctcaaacagccgcgccgaccgggagctggtccgtgaggatgatgggaggtggttccgctggtttgccgacccgctttacgggcgcggatatccctccgataaggtgtctgatttcactaagttgggagcactgcccaacggacttgattttgtgcaggcaggcgacatggacacgatcgcgacaccgactgattttatggggctaaactactactcccgaaatgtctaccgcgcggacggtgcagataatgatccgcaaactgttttcccacaaccgaagatgcccgaacactggaccgagatgggctgggaaatttacccggatgggctgaccaacattctgggacgcgtctatttcaactatcagccgcgcaaactatacgtcacagaaaacggcgccagttactccacgcctcctgatgataaggggaatgtcgcggatgaactccgcatccattatctgaggacacattttgcagctgcctatcgggccattcaaatgggcgtgcctctggcaggatacttcgtctggtccctcatggacaactttgagtggtcatggggctatatgcaacgctttggactcatctgggtggattatgagacccaaaaacgcactttaaaggatagcgcaaaatggtataagcgcgtgatcaagaagaatgggctctaa

SEQ ID NO: 322 - protein, 453 aa, Unknown
  Obtained from environmental sample
  DOMAIN (3)...(453): Glycosyl hydrolase family 1
  SITE (11)...(25): Glycosyl hydrolases family 1 N-terminal signature. Prosite id = PS00653
  SITE (49)...(52): N-glycosylation site. Prosite id = PS00001
  SITE (361)...(369): Glycosyl hydrolases family 1 active site. Prosite id = PS00572
MANKITFPENFLWGAATASYQIEGAWNKHGKGESTWDRFSHTPGKIRNNDTGDVANDHYRLWKKDIGLMKKIGLKAYRFSISWPRILPAGRGKVNQRGLDFYNKIVDELLKADIIPFVTLNHWDLPQKLEDEGGWPARSTADAFIEYTDVITRSLGDRAKNWITHNEPAVVAWMGYSTGQHAPGLKDYGLGARAAHHLLLSHGQAVPVIRSNSAGAEVGITLDISWRIAASNSRADRELVREDDGRWFRWFADPLYGRGYPSDKVSDFTKLGALPNGLDFVQAGDMDTIATPTDFMGLNYYSRNVYRADGADNDPQTVFPQPKMPEHWTEMGWEIYPDGLTNILGRVYFNYQPRKLYVTENGASYSTPPDDKGNVADELRIHYLRTHFAAAYRAIQMGVPLAGYFVWSLMDNFEWSWGYMQRFGLIWVDYETQKRTLKDSAKWYKRVIKKNGL

SEQ ID NO: 323 - DNA, 1362 bp, Unknown
  Obtained from environmental sample
atggcgaacaaaattacctttcccgaaaattttctttggggcgcggcaacagcctcctaccagatcgaaggtgcgtgggacaaacatggcaagggtgaatccatctgggatcgcttttcgcatacccctggcaagatcagaaataatgatacgggcgatgttgccaatgatcattatcgtctctggaaaaaagacattggcttgatgaagaagatcggcttgaaggcatatcgtttttccatttcgtggccgcgtgttcttcccgccggacgcggcaaagtcaatcagaagggactggatttctataacaggctggtagatgctctgttgaaagaagatatcatcccatttgtgactctcaatcactgggacctgccccaaaagctggaggaggaaggcggttggccggttcgctccaccgcagatgcctttgtggaatacacagacgtggtcacacgttccctcggcgaccgcgtaaagaattggatcacgcataatgagcctgccgtcgttgcctggatgggatattccacaggtcaacacgcacccggtttgaaggactatgggcttggtgtgcgcgccgcgcatcatctgctgctctcccacgggcaggcggtgccagtcatccgcagtaacagcgccgatgcagaagtgggcattacgctggatattagctggcggattcctgcctccaatagccgagcagaccgggaattggtccgtaaagatgacggactatggttccgctggttcgccgatccgctttatgggcgcggatacccctcggataaagtcaccgattttacaaagatcggcgcgctgcccaatggtctggactttatgcaagccggtgatatggatgcgatcgccacgccaaccgatttcatggggctgaactattatttccgaaatgtctaccgcgcgaatggcgaagacaatgatccgcaggtcgttttcccacaaccaaagatgcccgaacactggacggagatgggctgggaaatctatccggatggactgacgaacatcctgggacgcgtttatttcaattaccagccacataaactgtatatcacagagaacggcgcgagctactccaccccgcccgatgaaaaggggaatgtcgccgatgagctccgcactcattatttacggacacacttcgcggctgcctaccgggcgattcagatgggcgtgcctctggcaggatactttgtctggtccctcatggacaactttgagtggtcctggggatatatgcagcgctttgggctcatctgggtggactacgagacacagaaacgcaccctgaaggatagcgccaagtggtacaaacgtgtgatcaggaagaatgggttttag

SEQ ID NO: 324 - protein, 453 aa, Unknown
  Obtained from environmental sample
  DOMAIN (3)...(453): Glycosyl hydrolase family 1
  SITE (11)...(25): Glycosyl hydrolases family 1 N-terminal signature. Prosite id = PS00653
  SITE (49)...(52): N-glycosylation site. Prosite id = PS00001
  SITE (361)...(369): Glycosyl hydrolases family 1 active site. Prosite id = PS00572
MANKITFPENFLWGAATASYQIEGAWDKHGKGESIWDRFSHTPGKIRNNDTGDVANDHYRLWKKDIGLMKKIGLKAYRFSISWPRVLPAGRGKVNQKGLDFYNRLVDALLKEDIIPFVTLNHWDLPQKLEEEGGWPVRSTADAFVEYTDVVTRSLGDRVKNWITHNEPAVVAWMGYSTGQHAPGLKDYGLGVRAAHHLLLSHGQAVPVIRSNSADAEVGITLDISWRIPASNSRADRELVRKDDGLWFRWFADPLYGRGYPSDKVTDFTKIGALPNGLDFMQAGDMDAIATPTDFMGLNYYFRNVYRANGEDNDPQVVFPQPKMPEHWTEMGWEIYPDGLTNILGRVYFNYQPHKLYITENGASYSTPPDEKGNVADELRTHYLRTHFAAAYRAIQMGVPLAGYFVWSLMDNFEWSWGYMQRFGLIWVDYETQKRTLKDSAKWYKRVIRKNGF

SEQ ID NO: 325 - DNA, 1362 bp, Unknown
  Obtained from environmental sample
atggcaaataaaattctcttccccgagaactttctctggggcacggcgaccgcatcctaccagatcgagggggcttgggataaacatggtaagggcgagtcgacctgggaccgttttacgcatacacctggaaagatcaaaaacaatgatacgggcgatgtagcagatgaccattatcgattatggaaaaaagatatcggcttgatgaagaagctcggcttgaaggcttatcgtttttcgacttcctggccgcgggtgctgccggccgggcgcggtaagagcaatcaaaaaggactcgatttctacagcaagctggttgatgagttgctaaaagcaaatatcatcccattcgtgacattgaatcactgggacatcccacaaaagttggaggacgagggtggctgggccgtgcgctcaacggctgaggcatttgtggaatatgccgatctcatgtcgcgcacgcttggagaccgcgtcaagaactggatcacgcacaacgaaccggccgtcgtcgcctggatgggatacgggatgggcatccacgcgccgggcttaacggatttctcgattgcggtgccggtctcgcatcatctgctcctttcgcacggatgggccgtgcctgtgattcgcggtaacagcccggatgccgaggtgggcattaccctcaacattcaatggggcgaagcagcatccaacagccgggccgacctaaacgccctgcgcctgaacgatggacagtggttccgctggtttgccgatccggtttatggccgcggctatccttccgacgtggtggctgatttcgagaaaatgggcgcgctgccgaacggcatgaatttcgtgcaacctggcgatatggatgtcatcgccacgccaaccgatttcctcgggctcaattattattcccgccatgtgcatcgcgtcaacacaccggataacgatcaacaggttgtgtttgccaaacagcagggtcccgagaactggaccgagatgggctgggagatccatcctgatggattggccggaattttatccagagcgtatttcaattaccagccgcgcaaagtatatgtgactgaaaacggtgccagctattccaccgcgcccgatgagaatggtattgtcaacgacattcaccgcgtcaattatctacggacgcacttcgcggctgcccatcgcgccctgcaggcgggcgtgccattggcaggatacttcgtctggtcaatgctcgataacttcgaatggagtcacgggtacagccagcgctttggcatcgtttatgtggactatcaaacccagaagcgttacttgaaagacagcgccaagtggtacaaaggtgtcatcaaaaagaatgggttctaa

SEQ ID NO: 326 - protein, 453 aa, Unknown
  Obtained from environmental sample
  DOMAIN (3)...(453): Glycosyl hydrolase family 1
  SITE (11)...(25): Glycosyl hydrolases family 1 N-terminal signature. Prosite id = PS00653
  SITE (49)...(52): N-glycosylation site. Prosite id = PS00001
  SITE (332)...(335): N-glycosylation site. Prosite id = PS00001
  SITE (361)...(369): Glycosyl hydrolases family 1 active site. Prosite id = PS00572
MANKILFPENFLWGTATASYQIEGAWDKHGKGESTWDRFTHTPGKIKNNDTGDVADDHYRLWKKDIGLMKKLGLKAYRFSTSWPRVLPAGRGKSNQKGLDFYSKLVDELLKANIIPFVTLNHWDIPQKLEDEGGWAVRSTAEAFVEYADLMSRTLGDRVKNWITHNEPAVVAWMGYGMGIHAPGLTDFSIAVPVSHHLLLSHGWAVPVIRGNSPDAEVGITLNIQWGEAASNSRADLNALRLNDGQWFRWFADPVYGRGYPSDVVADFEKMGALPNGMNFVQPGDMDVIATPTDFLGLNYYSRHVHRVNTPDNDQQVVFAKQQGPENWTEMGWEIHPDGLAGILSRAYFNYQPRKVYVTENGASYSTAPDENGIVNDIHRVNYLRTHFAAAHRALQAGVPLAGYFVWSMLDNFEWSHGYSQRFGIVYVDYQTQKRYLKDSAKWYKGVIKKNGF

SEQ ID NO: 327 - DNA, 1398 bp, Unknown
  Obtained from environmental sample
atgccgatgagcacagaaacgacttttccttctgatttcacctggggcgcagcaacagccgcctaccagatcgaagggggcgatcgcgctggcgggcgcggccgttccgtgtgggacatgttttgcgagaaacgaggagctatttgggaggggcatacggggcagcgagcgagtctgcatcttcagcgctggcgtgaggacgtaatgttgatgcaacagctcggactgcggggctatcgttttagcgtcagctggccgcgcgtcttcccgacaggagtcggcaaagtcaaccgtgaagggttggccttttacgatcagctcgtagacgccttgctcgaggccggcatcaccccctttataacgctatttcattgggacttcccgctcgatttgtaccaccgaggcggctggttgaatcgcgacagcgccgactggtttgcctcctacgccgagtgcctcggcaaggcactgggcgacagggtcaagcactgggtgaccctcaacgagccgcaggttttcataggcctcggtcattacgaagggcgtcatgccccggggttgaagctctccatcgcggaaatgctgcgctgcgggcaccacgccttgctcgcgcacgggaaggccgtgcaagccctgcgcgcttccgtcgacggcccctgcaagattggatttgctccggtggggattcccaagcttccggcgagtgagagctcagaggatatcgccgcggcacgaaaggcccagttcgcggcgggagcgccgccgtattggacgctgagctggtgggcggatccggtgtttcaggggacatatcccgctgatgcctgccaggctctcggagcggacgcgccgcaggtggccgatcacgacatgagcatcatcagcgagccgactgatttcctgggcctcaacctttatcaaggggtggtggtgcgtgccgatcacacgggtcaaccagaaacggtgccgtttccgccgggattccccgtgactgcgctcaactgggccgtaaccccagaggcgctgtattggggcccgcgctttgccttcgaacgctacaaaaagccgattcacatcacggaaaacgggctatcctgtcgtgactggccgtcgctcgacgggcacgtccacgacgccgaccgcatcgacttcatggcccggcacttgcgcgcagcgcatcgagccattcgcgatgggataccgatcgaaggctacttccactggtctgcgatcgacaacttcgagtgggcagaaggctacaaggaacgcttcgggctcatttacgtcgactatacgagcggcgagcgcattccgaaggactcgtaccactggtaccagaaggtcattgcctccgaggggcgggcagcgctcggcgcgcccagtgctgctcgcccataa

SEQ ID NO: 328 - protein, 465 aa, Unknown
  Obtained from environmental sample
  DOMAIN (5)...(454): Glycosyl hydrolase family 1
  SITE (13)...(27): Glycosyl hydrolases family 1 N-terminal signature. Prosite id = PS00653
MPMSTETTFPSDFTWGAATAAYQIEGGDRAGGRGRSVWDMFCEKRGAIWEGHTGQRASLHLQRWREDVMLMQQLGLRGYRFSVSWPRVFPTGVGKVNREGLAFYDQLVDALLEAGITPFITLFHWDFPLDLYHRGGWLNRDSADWFASYAECLGKALGDRVKHWVTLNEPQVFIGLGHYEGRHAPGLKLSIAEMLRCGHHALLAHGKAVQALRASVDGPCKIGFAPVGIPKLPASESSEDIAAARKAQFAAGAPPYWTLSWWADPVFQGTYPADACQALGADAPQVADHDMSIISEPTDFLGLNLYQGVVVRADHTGQPETVPFPPGFPVTALNWAVTPEALYWGPRFAFERYKKPIHITENGLSCRDWPSLDGHVHDADRIDFMARHLRAAHRAIRDGIPIEGYFHWSAIDNFEWAEGYKERFGLIYVDYTSGERIPKDSYHWYQKVIASEGRAALGAPSAARP

SEQ ID NO: 329 - DNA, 1350 bp, Unknown
  Obtained from environmental sample
atgtcagatgccgccccgactgatccgaaatccgcaatgcccagacgctcggacttccccgagggttttgtcttcggcgcggccaccgcggcctatcagatcgagggccatgccttcggcggcgcgggcccctgccattgggacagcttcgccgcaaccgggcgtaacgtggtcggcaatgaggatggcgcgcgcgcctgcgagcattacacccgctggccgcaggatctggacctgatccgcgaggccgggctcgacgcctaccgcttctcgacctcctgggcgcgggtgatgcccgatggcgtgaccctgaaccccgaggggctggatttctacgaccgcctcgtcgatggcatgctcgagcgcgggctaaagccctatctcaccctctaccattgggaattgccctcggcgcttgccgacaggggcggctggaccaatcgcgacacggccgagcgctttgccgatttcgcagcggtggtgatggagcggttgggcagccgcgtcgcccgcacggccaccatcaacgagccatggtgcgtgagctggctctcgcatttcgaaggccatcacgcgccgggcctgcgcgacatccgtgccaccgcacgcgccatgcatcatgtgcaactggcgcacggcctcgcgctcgggaagctgcgcgcgcaggggcatggcaatctcggcatcgtgctgaatttctcggaaatcattcccgccgggcgagagcacgcgaaggcggctgatctcggcgacgcaatctcgaaccgctggttcatcgagtcagtcgcgcgtggcacctatcccgatgtggtcctcgagggtctgggcaagcacatgcccgagggctggcaggatgacatgaaaaccatcgcggccccgctcgactggctgggtgtgaactactacacccgcggcatcgtcgcgcatgacccggacgcgtcctggccctcgacccgagcggaggaggggcccctgcccaagacgcagatgggctgggagatctaccccgagggcttgcgcaacctgctggtgcgcatggcgcgcgactatgtgggcgaccttcccatggtcgtgaccgaaaacgggatggcctgggccgacgaggtcgcggatggcgccgtcagagatacgatccgcaccgaatatgtcgcagcccatctcaacgcgacccgcgaggcgctggccggcggggcgaatatcgaaggtttcttctattggtcgctgctcgacaattacgaatgggccttcggctatgccaagcgcttcggcctcgtccatgtcgatttcgacacgatggcacgcacgccgaaagcctcctaccacgcgctgagggccgcgctgcagggttga

SEQ ID NO: 330 - protein, 449 aa, Unknown
  Obtained from environmental sample
  DOMAIN (15)...(443): Glycosyl hydrolase family 1
  SITE (235)...(238): N-glycosylation site. Prosite id = PS00001
  SITE (361)...(369): Glycosyl hydrolases family 1 active site. Prosite id = PS00572
  SITE (393)...(396): N-glycosylation site. Prosite id = PS00001
MSDAAPTDPKSAMPRRSDFPEGFVFGAATAAYQIEGHAFGGAGPCHWDSFAATGRNVVGNEDGARACEHYTRWPQDLDLIREAGLDAYRFSTSWARVMPDGVTLNPEGLDFYDRLVDGMLERGLKPYLTLYHWELPSALADRGGWTNRDTAERFADFAAVVMERLGSRVARTATINEPWCVSWLSHFEGHHAPGLRDIRATARAMHHVQLAHGLALGKLRAQGHGNLGIVLNFSEIIPAGREHAKAADLGDAISNRWFIESVARGTYPDVVLEGLGKHMPEGWQDDMKTIAAPLDWLGVNYYTRGIVAHDPDASWPSTRAEEGPLPKTQMGWEIYPEGLRNLLVRMARDYVGDLPMVVTENGMAWADEVADGAVRDTIRTEYVAAHLNATREALAGGANIEGFFYWSLLDNYEWAFGYAKRFGLVHVDFDTMARTPKASYHALRAALQG

SEQ ID NO: 331 - DNA, 1116 bp, Unknown
  Obtained from environmental sample
atgaataaaatcctcaaactcttcagcagcctgctgctttttgcaggcatctgtcccgcgcttcaggcagagccagtagaaacctactttcccctgtcccgcgggatcaacatgagccactggctctctcaagtgaatgaaaacattcccgaccgttccacctatgtgacggagcgggatttgcaatttctgcgggcagccggtttcgaccatgtgcgtctgccaatcgatgaggtcgaactctgggatgaagagggcaatcagatcgaggaggcctggcaatacatgcataactttctccgttggagccgaaagaacgatctccgggtcattctcgacctgcacacggtattgtcccaccacttcaacgcggtaaatatgggagaggtcaatacactcttcaatgatcccagggaacaggaaaagttcctcaacctatgggaacaaatcatggatgccgtgggtcaccatccgaatgagtttctcgcctatgaaatgctcaatgaggcggtcgcggaagatgatgaagactggaatctgctcctcaaccgcgccattgtccgcatccgggaccgtgagccttatcgggtgctgattgcggggtcgaactggtggcagcatgccgaccgggtccccaacctgaggctcccgaaaggagaccccaatatcatcatcagttttcatttttattccccttttctcttcacccactaccgcagtagctggactgcgatgcaggcgtaccagggcttcgtccaataccctggcaaaaccataccttccatacatctcgaaggcatgaactacccggagtccttcgttcatatgtgggaagcgcacaatcggtactatgacatccattccatgtatgccgaaatggtcccggcggtgcgttttgccgaaaagttgggacttcggctctattgcggagaattcggggccatgaagaccgttgatcgcgcccagatgctgcagtggtatcgggatgttgtcactgtatttaataaattgggtattccctatactgcctgggattatcagggaaccttcggaatccgcgatgagctgaccggtgagcccgatcatgaaatgatcgatattctcctcgggcgctga

SEQ ID NO: 332 - protein, 371 aa, Unknown
  Obtained from environmental sample
  SIGNAL (1)...(23)
  DOMAIN (39)...(350): Cellulase (glycosyl hydrolase family 5)
  SITE (37)...(40): N-glycosylation site. Prosite id = PS00001
MNKILKLFSSLLLFAGICPALQAEPVETYFPLSRGINMSHWLSQVNENIPDRSTYVTERDLQFLRAAGFDHVRLPIDEVELWDEEGNQIEEAWQYMHNFLRWSRKNDLRVILDLHTVLSHHFNAVNMGEVNTLFNDPREQEKFLNLWEQIMDAVGHHPNEFLAYEMLNEAVAEDDEDWNLLLNRAIVRIRDREPYRVLIAGSNWWQHADRVPNLRLPKGDPNIIISFHFYSPFLFTHYRSSWTAMQAYQGFVQYPGKTIPSIHLEGMNYPESFVHMWEAHNRYYDIHSMYAEMVPAVRFAEKLGLRLYCGEFGAMKTVDRAQMLQWYRDVVTVFNKLGIPYTAWDYQGTFGIRDELTGEPDHEMIDILLGR

SEQ ID NO: 333 - DNA, 1383 bp, Unknown
  Obtained from environmental sample
atgagcaaactccccaaattcctctttggagccggcacctcaagttatcagatcgaaggtgcctggaatatagatggcaaaggtccctccatttgggatttccacactcgccatcccggcgcggtttatcggatgcacaacggggatatggcctgcgatcattatcatcggtatcgaacggatatcgagctgatgcagaagatcggcctagaggcttaccgcttttccataaactggccccgggttctgccggaagggaccggtgccgccaatgaagcaggtctggacttttacgaccggctggtggacgcactgttggaagcgggaattcagccttggatcaccctttatcactgggaactcccctgggctctccacctgcgcgggggttggctcaatcgggacatgcccgaccacattgagaactacgccgccttggtcgccaggtgcctcggtgaccgggtgaaaaactggattactttgaatgagcctcaggttttcatcgggcttggctatgccagcggggttcatgcccccggctataagttgtccttgcgggagtgcctggtcggttcccaccatgccgtgctttcccaccaccgggcagtcaaggcgatccgggccaactgcgaaggcagcgtccagatcggctcagccccggtgggtgttgtctgccgaccggaaacggagtcggcagcagacattgaggctgcccgccaggccacctaccatatcaacactcccagcacccacactcccgacaatctgatcggctgcctctggaacagcacttggtggatagatccaatggttctggggaagtatccggaacacgggctgaaagcctttgaaagctatctgccggacaacattcaggccgaactggatgccgtattcgaaccgacggactttgtcggttccaacatctaccacggccgcacggtgcgggccaagcaggatggtggttttgagtttatcgaccttccgcccggcagcccccgcaccaccatgggctgggacatcaccccggacatcctctactggggaggaaagtatctttacgaacgctatggcaagccgatgtttatcacggaaaacggcattgccgtcccggaactggtgaatgatgaaggccaggtcgaggataccgtccgtgagcaatacatgaagctgcacctgcgtgggctgcagcgggcccgcgatgaaggcatcccctatgccggatacttccactggtccctgctcgacaacttcgagtgggaacaaggctactcccagcgctttggcatggtctacgtcgactaccagacccaggaacgtatcctcaaacgttcgggccagcatttcgctgccatcgtccgggaaatcaccggaaccgcctaa

SEQ ID NO: 334 - protein, 460 aa, Unknown
  Obtained from environmental sample
  DOMAIN (1)...(458): Glycosyl hydrolase family 1
  SITE (7)...(21): Glycosyl hydrolases family 1 N-terminal signature. Prosite id = PS00653
  SITE (266)...(269): N-glycosylation site. Prosite id = PS00001
  SITE (366)...(374): Glycosyl hydrolases family 1 active site. Prosite id = PS00572
MSKLPKFLFGAGTSSYQIEGAWNIDGKGPSIWDFHTRHPGAVYRMHNGDMACDHYHRYRTDIELMQKIGLEAYRFSINWPRVLPEGTGAANEAGLDFYDRLVDALLEAGIQPWITLYHWELPWALHLRGGWLNRDMPDHIENYAALVARCLGDRVKNWITLNEPQVFIGLGYASGVHAPGYKLSLRECLVGSHHAVLSHHRAVKAIRANCEGSVQIGSAPVGVVCRPETESAADIEAARQATYHINTPSTHTPDNLIGCLWNSTWWIDPMVLGKYPEHGLKAFESYLPDNIQAELDAVFEPTDFVGSNIYHGRTVRAKQDGGFEFIDLPPGSPRTTMGWDITPDILYWGGKYLYERYGKPMFITENGIAVPELVNDEGQVEDTVREQYMKLHLRGLQRARDEGIPYAGYFHWSLLDNFEWEQGYSQRFGMVYVDYQTQERILKRSGQHFAAIVREITGTA

SEQ ID NO: 335 - DNA, 1353 bp, Unknown
  Obtained from environmental sample
atgaaaaaatacctttttcctgaaaattttttatggggtgctgccacagcttcgtatcaaatcgaaggttctccctctgctgatggcaaaggtgaatcgatatgggaccgtttttctcacacaccggggaacatttggaacgctgaaaccggggatatcgcctgcgatcattaccggcgttacgtggatgatgtaaagctgatttcacaaatcgggcttaacgcgtaccgtttttcaatttcctggcccagggtatttccagaggggagaggaaaagcaaatgaaaaaggactcgatttttaccgcaggttgattgaacagctgcagcaacatcgaatcaaaacggcagtgacactttaccactgggatcttccacaagttctgcaggatcgcggcgggtgggcaaaccgtgatacggcgaagtatttttctgagtatgccacctttctctttgaaaaactcgatctccccgttgacatgtggattactcttaacgaaccatgggttatcgctattctggggcatgcttttggtatccacgctccagggatgagtgacttcagcacagccctccaggtctcgcataacctgcttctggggcacgggttggcggttaaagcatttcgggagtctaagaggggtgatgaaccggtaggtattacccttaaccttgccccggttgaaccgctgaccgaaaagcccgccgatctaaaggcagctttactttctgacggttttatgaaccgctggtaccttgatcccctgttcaaaggtggttaccctgaagatatgatggatatctattcccggaactttgaactgcccaaaattgaaaagggggatgctcaggttattgccgaaccgatcgacttcctgggcataaataactataccagggttctcgtggaagccagcggtgatgaaaatgcctttatgggcaaccctgtcaacccccagggctctgaatatactgaaatgggttgggaggtttatccgcagggtctctacgacctgctgaccagggttcaccgggattacgggccaatgccgctatatataactgaaaacggggcagcctttcccgatgaacttgacagcaatgggcagatagatgatccaaggcggataaattacctggaaacttatcttcatcagtgctggaaggcagttcaggacggtgtgcctctaaaaggctattttgtctggaccctgatggataacttcgagtgggctttcggtttcagcaagcgatttgggctcatatacgtagattaccaggatcagaaacgttacttgaaaaacagcgcctactggtatagcaaggttattgggcgaaacggcctcgagctataa

SEQ ID NO: 336 - protein, 450 aa, Unknown
  Obtained from environmental sample
  DOMAIN (4)...(448): Glycosyl hydrolase family 1
  SITE (10)...(24): Glycosyl hydrolases family 1 N-terminal signature. Prosite id = PS00653
  SITE (300)...(303): N-glycosylation site. Prosite id = PS00001
  SITE (356)...(364): Glycosyl hydrolases family 1 active site. Prosite id = PS00572
MKKYLFPENFLWGAATASYQIEGSPSADGKGESIWDRFSHTPGNIWNAETGDIACDHYRRYVDDVKLISQIGLNAYRFSISWPRVFPEGRGKANEKGLDFYRRLIEQLQQHRIKTAVTLYHWDLPQVLQDRGGWANRDTAKYFSEYATFLFEKLDLPVDMWITLNEPWVIAILGHAFGIHAPGMSDFSTALQVSHNLLLGHGLAVKAFRESKRGDEPVGITLNLAPVEPLTEKPADLKAALLSDGFMNRWYLDPLFKGGYPEDMMDIYSRNFELPKIEKGDAQVIAEPIDFLGINNYTRVLVEASGDENAFMGNPVNPQGSEYTEMGWEVYPQGLYDLLTRVHRDYGPMPLYITENGAAFPDELDSNGQIDDPRRINYLETYLHQCWKAVQDGVPLKGYFVWTLMDNFEWAFGFSKRFGLIYVDYQDQKRYLKNSAYWYSKVIGRNGLEL

SEQ ID NO: 337 - DNA, 1014 bp, Unknown
  Obtained from environmental sample
atgtccaggggcatcctgatcctcgtcatgctgtctgttctgagcggcgcggcgctggcccaaccggccgggctgccgccgcgttcgccggtgcagcgctgcatcaacctgggcaatatgctggaagcgccggaggagggctggtgggggctgcgcgtcgagcgcgactacctgacgacgatcgccggggccgggttcgatgcggtgcgcatcccgataagctggtcaacccatgctgccagcgagccgccctacaccatcgatccggctttcttcgcccgcgttgatgaagtcgtcggctgggcgctggcggacgggctgaaggccatcatcaacgtgcaccactacgaggagatgatgagcgatccggcggggcatttcccccggctgcgcgcgctgtgggcgcagatcgcggagcactacgccgactacccgcccgcgctgatgttcgagctgctcaacgaaccgttcgaggcgctgacgccgctgcggtggaacgagtacgccgccgatctgatcgcgctgatccgccagaccaacccggggcgcaccctgatcgtcggcgggggctggtggaacagtgtggaagggctgatgcagctccgcctgccggatgatcccgatctgctggcgacgttccattactaccacccgttcgagttcacgcatcagggggcggagtggtcaccggaagtgactgacctgagcgggatcgcctgggggacgggcgaggaacggctcgatctggagtccaatatccgtattgcggcggcctgggcggtgtacaaccggcgcccgctgctgttgggcgaattcggcgtctatggccgggtggccgatctcgattcgcgcctgcgctggacgacggcggtgcgcgccgaggccgaggcgcagggcatcggctggtgctactgggaattcgccgccggcttcggcatttacgacccggaaagccggacgttcaacccgctgtaccgcgcgctgatcccgcaggccgggccggcgcgcccctga

SEQ ID NO: 338 - protein, 337 aa, Unknown
  Obtained from environmental sample
  SIGNAL (1)...(20)
  DOMAIN (38)...(314): Cellulase (glycosyl hydrolase family 5)
  SITE (150)...(159): Glycosyl hydrolases family 5 signature. Prosite id = PS00659
MSRGILILVMLSVLSGAALAQPAGLPPRSPVQRCINLGNMLEAPEEGWWGLRVERDYLTTIAGAGFDAVRIPISWSTHAASEPPYTIDPAFFARVDEVVGWALADGLKAIINVHHYEEMMSDPAGHFPRLRALWAQIAEHYADYPPALMFELLNEPFEALTPLRWNEYAADLIALIRQTNPGRTLIVGGGWWNSVEGLMQLRLPDDPDLLATFHYYHPFEFTHQGAEWSPEVTDLSGIAWGTGEERLDLESNIRIAAAWAVYNRRPLLLGEFGVYGRVADLDSRLRWTTAVRAEAEAQGIGWCYWEFAAGFGIYDPESRTFNPLYRALIPQAGPARP

SEQ ID NO: 339 - DNA, 1389 bp, Unknown
  Obtained from environmental sample
atgagcgcttcgagtccctcccgccccctgtccttcccagagcagttcgtctggggtgctgccgcggcctcctaccaagtcgagggcgccgtccacgaggacgggaagggcccctccgtctgggacatgttctgcgagaagcccggagcggtcttccaggggcacgacggggcggtggcttgcgaccactatcaccgctaccgagaggacgtggcgttgatgcgacaggtgggcctgcacgcctaccgcctgagcgtgtgctggccccgagtgctcccggagggcgtcgggcagcccaacgagaagggcctcgacttctactcgcggttggtggacgcgctgctcgaggcagggattacgccctgggtaacgctttttcattgggactaccccttggctctctatcaccgggggggctggctcaaccgggatagcgcggattggtttgccgagtacgcgggcctaatcgccgatcgcctctccgaccgggtgcagcatttcttcactcagaacgagccccaggtctatatcggcttcggacacctcgagggtaagcatgctccaggagacaccttgcccatgtcccaggtgctgcttgcggggcatcatagcctactggcgcacggcaaggccgtgcaggcgctccgcgcccaggcgaagcagcagctgcgcgtcggctacgctcccgtcggcatgcccctccatcccttcacggactcggccgaggacgtggccgctgcgcggaaggcgaccttttgggttcgggagaagaactcctggaacaacgcctggtggatggacccggtgttcttgggtgagtacccggctcagggcctcgccttcttcggccgggacgtgccgcaggtgcgcgagggagacatgcagctcatcgcgcagcccttggacttctttggggtcaacatctaccagagcacccccgtgcgcgcgtctagcgccgaaagcggcttcgaggtcgtcccccatccaacgggctatcctatcactgccttcaactggccgatcacgccccaggccctctactggggtccgcgcttcttctacgagcgctaccagaagccgatcgtcatcacggagaacggactgtcctgtcgggacgtcgtcgctgtggacgggaaggttcacgatccggctcgcatcgatttcaccacccgctatctgcgcgagctccaccgagccgtcgcggacggcgtcgcggtcgagggctacttccactggtccatcatggacaacttcgaatgggctgccggctaccgcgagcggttcgggctcattcacgtcgactacgagaccctggcgcggacgcccaaggcgtccgctgcgtggtatcgcaaggtaatcgagagcaacggagcgacccttttcggatga

SEQ ID NO: 340 - protein, 462 aa, Unknown
  Obtained from environmental sample
  DOMAIN (8)...(458): Glycosyl hydrolase family 1
  SITE (16)...(30): Glycosyl hydrolases family 1 N-terminal signature. Prosite id = PS00653
  SITE (366)...(374): Glycosyl hydrolases family 1 active site. Prosite id = PS00572
MSASSPSRPLSFPEQFVWGAAAASYQVEGAVHEDGKGPSVWDMFCEKPGAVFQGHDGAVACDHYHRYREDVALMRQVGLHAYRLSVCWPRVLPEGVGQPNEKGLDFYSRLVDALLEAGITPWVTLFHWDYPLALYHRGGWLNRDSADWFAEYAGLIADRLSDRVQHFFTQNEPQVYIGFGHLEGKHAPGDTLPMSQVLLAGHHSLLAHGKAVQALRAQAKQQLRVGYAPVGMPLHPFTDSAEDVAAARKATFWVREKNSWNNAWWMDPVFLGEYPAQGLAFFGRDVPQVREGDMQLIAQPLDFFGVNIYQSTPVRASSAESGFEVVPHPTGYPITAFNWPITPQALYWGPRFFYERYQKPIVITENGLSCRDVVAVDGKVHDPARIDFTTRYLRELHRAVADGVAVEGYFHWSIMDNFEWAAGYRERFGLIHVDYETLARTPKASAAWYRKVIESNGATLFG

SEQ ID NO: 341 - DNA, 1377 bp, Unknown
  Obtained from environmental sample
atgacacaactggcttttccatctaacttcatctggggaacagctacttccgcttaccaaatcgaaggcgcctggaacgcagacggcaagggcgaatctatttgggatcgcttttcccatacgcaggggaagatcattgacggcagcaacggcgatgtggcctgcgatcactaccaccgctggcgcgaggacgtggccctcatgagagacttgggtatgcaggcatatcgcttctccatctcctggccacgcatcctgcccaccggtcatggacagatcaatcaggctgggctggacttttacaatcgcctggtggacgggttgctggaagctggcatcaagccctttgccaccctctaccactgggacctgccgctggcgctacaggctgacggcggctggccggagcgctccacggccaaggcctttgtcgaatacgccgacgtggtcagccgcgcgctgggcgatcgggtgaagagctggatcacccataacgaaccgtggtgcatcagcatgctgagccatcaaattggggagcatgcgcccggctggcgggactggcaggctgcgttggcggccgcgcaccacgtcctcctttcgcatggttgggccgtgccggaactgcgtcgcaacagccgcgatgcagaaatcggcatcacgttgaactttaccccggcggagccagcttcgaacagcgcagccgatttcaaggcctatcgccagttcgatggctacttcaaccgctggttcctggacccgctctatggccgccactatccggcagatatggtgcacgattacatcgcgcaaggctacctgccatcacagggtttgactttcgtggaagctggtgacctggacgcgatcgcgacgcgcaccgatttcctgggtgtgaactattacacgcgcgaagtggtccgtagccaggaaatcccagagagtgagaacgcgccgcgcacagtcttgcgcgcgccacaggaagagtggacagagatgggctgggaagtgtatcctgagggcctctacaggttgctcaatcggttgcactttgaataccagccgcgcaagctctacgtgaccgagagcggttgcagctactccgatggacccggccccaacggtcggataccggaccaacgccgtatcaactacctgcgcgatcacttcgcagcggcgcatcaggcgatacaatgcggcgtcccgctggccggctacttcgtctggtcgttcatggacaacttcgagtgggccaaagggtacacccaacgttttggtatcgtatgggtggattatcaatcgcaacgacggataccgaaagacagcgcctactggtatcgcgatgtcgtcgccgccaacgcggtgcaagttcctgattag

SEQ ID NO: 342 - protein, 458 aa, Unknown
  Obtained from environmental sample
  DOMAIN (2)...(454): Glycosyl hydrolase family 1
  SITE (10)...(24): Glycosyl hydrolases family 1 N-terminal signature. Prosite id = PS00653
MTQLAFPSNFIWGTATSAYQIEGAWNADGKGESIWDRFSHTQGKIIDGSNGDVACDHYHRWREDVALMRDLGMQAYRFSISWPRILPTGHGQINQAGLDFYNRLVDGLLEAGIKPFATLYHWDLPLALQADGGWPERSTAKAFVEYADVVSRALGDRVKSWITHNEPWCISMLSHQIGEHAPGWRDWQAALAAAHHVLLSHGWAVPELRRNSRDAEIGITLNFTPAEPASNSAADFKAYRQFDGYFNRWFLDPLYGRHYPADMVHDYIAQGYLPSQGLTFVEAGDLDAIATRTDFLGVNYYTREVVRSQEIPESENAPRTVLRAPQEEWTEMGWEVYPEGLYRLLNRLHFEYQPRKLYVTESGCSYSDGPGPNGRIPDQRRINYLRDHFAAAHQAIQCGVPLAGYFVWSFMDNFEWAKGYTQRFGIVWVDYQSQRRIPKDSAYWYRDVVAANAVQVPD

SEQ ID NO: 343 - DNA, 987 bp, Unknown
  Obtained from environmental sample
atggttgagcctgccgatcagagtcatttttcagatgcttttcaggtaaatcgcactcttggaaaaggcatcaatcttggtaacacactggaggctccaaatgaaggcgagtggggattgacaattcgcgaggagtattttgatgaagtgaaacaagccggatttgaatccgtgcgtattccgatacgatggaatgctcatgctctggaaggttttccatatacgatagatgaatctttttttgaccgggttgatgaagttattggctgggcttttgatcgtgatcttgcagtcatgattaacattcatcactacaacgaattgatggagcagccacaggatcaccgggatcgctttttgaaactttgggagcaaattgctgcgcactataaagagtacccggaagaactggtattcgagattttaaacgaaccccacgataatctgaccccggctatctggaatagctttttggctgatgctctcggtattatacgccaaaccaatccaggaagggttattgcagtcggaacagctgaatggggcggtttcgggagtttgcaggatcttgagctgcctgataatgaccgccagataatcaccaccgttcattactataacccatttcatttcacgcatcagggggcagattgggttggagatgaagcggatcagtggcttggaaccgaatgggatggagcagatcatgaaaaagctgaagttgacagcgattttgactctgtggaacagtgggcccgaaatcatgaccggccaatacacgtgggagagttcggagctttcagcgccgcagatgatttgtcacgtgaacagtggacggcatacgtacgtgagtcttcggagaaccggcagtttagctgggcgtattgggagtttgggtcagggttcggtgcctatgatcccggttccggagaatggcgtgaatatttactccgggcgttaatccccgacagtccggtgattgattaa

SEQ ID NO: 344 - protein, 328 aa, Unknown
  Obtained from environmental sample
  DOMAIN (27)...(306): Cellulase (glycosyl hydrolase family 5)
  SITE (17)...(20): N-glycosylation site. Prosite id = PS00001
  SITE (139)...(148): Glycosyl hydrolases family 5 signature. Prosite id = PS00659
MVEPADQSHFSDAFQVNRTLGKGINLGNTLEAPNEGEWGLTIREEYFDEVKQAGFESVRIPIRWNAHALEGFPYTIDESFFDRVDEVIGWAFDRDLAVMINIHHYNELMEQPQDHRDRFLKLWEQIAAHYKEYPEELVFEILNEPHDNLTPAIWNSFLADALGIIRQTNPGRVIAVGTAEWGGFGSLQDLELPDNDRQIITTVHYYNPFHFTHQGADWVGDEADQWLGTEWDGADHEKAEVDSDFDSVEQWARNHDRPIHVGEFGAFSAADDLSREQWTAYVRESSENRQFSWAYWEFGSGFGAYDPGSGEWREYLLRALIPDSPVID

SEQ ID NO: 345 - DNA, 1350 bp, Unknown
  Obtained from environmental sample
atgctgtcctatacgagtccgttcccaaagaactttgtctggggtgtggcgacggcggcgccgcagatcgagggcgctgcgcgagaagacggaaagggcgaatcgatatgggatcgcttttgccgcgtgcccggaaaggtccacaatggcgatactctcgatgttgcgtgcgaccactaccaccggttccgggaggatttcgcgctcatgcgagacttgggcgtgcgccactaccggctttcgcttgcctggccccgcatattcccggacggcgacggcgcattgaaccagcgcggagtggatttctaccaccggctctttgaggccatgatcgagcacgggattacgccttgggtgacgctctttcactgggatttgccgcaggcgctcgaggaccgcggcggctggtgtgagcgtctcaccgtcgatgcattcgggcgctacgctgacaccgtggtgaaggcgtttggcgatcgcgtgaagaattggatcaccctgaacgaaatccgctgcttcacgttgctcgcttacgatctctgcatcaaggccccgggccgcaaggtctcgcgggcgcagctcaaccagacctatcatcacgcgctgatctgccatgggcatggcgtccgggcggtccgcgaacacggcgggcgaggcgctcgcgtcgggcttaccgacaacagcgacgtatgcgtgcccgtcaccgagaccgcgcccgacatcattgcggccagatcctggtatgcgtcgcgaaatattcatctgctcgatccgatctatcgcggcgagtatgcgccggaatacctcgaacgctgcggtgcggacgcgccccaggtggccgaggacgatttcgcgctgatttcaatgccgacggattttctcgggctgaatgtatatacggcgacctttgtgcgtgccgacgcggagggcaggccggaggagattaaactgccgcggaattacccgcgcgcggatagcgcgtggttgaatattgtgccccagtcgatgtactgggccacacggctggcgcgggaaacctacggcgtgagatcaatctacatcaccgaaaacggctgcggctacgacgacgagcccgtcgacggcggcgaggtgctcgacctgcatcgacgcgattttctgcgcaaccaccttcgggaattgcatcgcgccataggcgacggcgtgcccgttgacgggtattttctctggtccttcatggacaactacgagtgggaggacgggtatgcgcggcggttcggcatcgttcacgtcgacttcgaaagccagaaacggactccaaaactctcggcgcgctattacgcgcaggtaatgaaagaaaaccggatcctgtga

SEQ ID NO: 346 - protein, 449 aa, Unknown
  Obtained from environmental sample
  DOMAIN (4)...(448): Glycosyl hydrolase family 1
MLSYTSPFPKNFVWGVATAAPQIEGAAREDGKGESIWDRFCRVPGKVHNGDTLDVACDHYHRFREDFALMRDLGVRHYRLSLAWPRIFPDGDGALNQRGVDFYHRLFEAMIEHGITPWVTLFHWDLPQALEDRGGWCERLTVDAFGRYADTVVKAFGDRVKNWITLNEIRCFTLLAYDLCIKAPGRKVSRAQLNQTYHHALICHGHGVRAVREHGGRGARVGLTDNSDVCVPVTETAPDIIAARSWYASRNIHLLDPIYRGEYAPEYLERCGADAPQVAEDDFALISMPTDFLGLNVYTATFVRADAEGRPEEIKLPRNYPRADSAWLNIVPQSMYWATRLARETYGVRSIYITENGCGYDDEPVDGGEVLDLHRRDFLRNHLRELHRAIGDGVPVDGYFLWSFMDNYEWEDGYARRFGIVHVDFESQKRTPKLSARYYAQVMKENRIL

SEQ ID NO: 347 - DNA, 1188 bp, Unknown
  Obtained from environmental sample
atgaccatcaccttccccgacgggttctggtgggggacggcgacggccgcccaccaggtggagggcggcaactggaacaccgactggtgggcctacgagcacgccccgggcacccgctgcgcggagccgtccggcgatgcgtgcgaccactggcaccgctacccggaggacatcgccctcctcgccgcgctcgggttcagtgcctaccgcttctcggtggaatgggctcgcatcgagcccgaggaagggcatttctcccgcgccaccctcgaccactaccggcgcatgatcgcctgctgccgcgaccacgggctggccccggtggtgaccttccaccacttcaccaccccccgctgggccgcggccgggggctgctggtccgacccggtcaccgccgagcgcttcgcccgttactgcgagcgcaccgtggccgccctcggcgacgagatcgcgatggcctgcacgatcaacgagccgaacatcgtggccaccctcgggtacttcctcggcgagttcccgccggccgtcgccgaccccgaccgctaccggcaggcgaacgacacgctgatccgcgcccatcgcctcgcctacgaggcgctgaaggccgggcccggcgagttccccgtcggcctcaccctgtcgatggccgagttcgtcgccgagcccggcggcgaggcccacctcgcccaggtccggcacacgatggaggacatcttcctggaggccgcccggggcgacgacttcatcggggtgcagacctacagccgcatgcgcttcggtcccgactcgccgatcccgctcgggccggccgagggcgtcgaggtcgtccagatggggtacgagtactggccgtgggcgctcgaggcgacgatccggcgcgccgccgaggtcaccggcacggcggtccacgtcaccgagaacggcatcgggaccgccgacgacacgcagcgggtcgcctacgtcaccgaggccctccgggggctgcggcgctgcctcgacgacggcatcgacgtccgcagctacttctactggacgctgctcgacaacttcgagtggacgcgcggctacgtgccgacgttcgggctcgtcgccgtcgaccgcaccacccagcgccggtcggtgaagccgagcgcggtgtggctcggcgaggtcgcccgcacgaaccgcctcgagctcccggaccgctga

SEQ ID NO: 348 - protein, 395 aa, Unknown
  Obtained from environmental sample
  DOMAIN (1)...(390): Glycosyl hydrolase family 1
  SITE (9)...(23): Glycosyl hydrolases family 1 N-terminal signature. Prosite id = PS00653
  SITE (188)...(191): N-glycosylation site. Prosite id = PS00001
MTITFPDGFWWGTATAAHQVEGGNWNTDWWAYEHAPGTRCAEPSGDACDHWHRYPEDIALLAALGFSAYRFSVEWARIEPEEGHFSRATLDHYRRMIACCRDHGLAPVVTFHHFTTPRWAAAGGCWSDPVTAERFARYCERTVAALGDEIAMACTINEPNIVATLGYFLGEFPPAVADPDRYRQANDTLIRAHRLAYEALKAGPGEFPVGLTLSMAEFVAEPGGEAHLAQVRHTMEDIFLEAARGDDFIGVQTYSRMRFGPDSPIPLGPAEGVEVVQMGYEYWPWALEATIRRAAEVTGTAVHVTENGIGTADDTQRVAYVTEALRGLRRCLDDGIDVRSYFYWTLLDNFEWTRGYVPTFGLVAVDRTTQRRSVKPSAVWLGEVARTNRLELPDR

SEQ ID NO: 349 - DNA, 1323 bp, Unknown
  Obtained from environmental sample
atgtcaacctataaatttccgcacaactttttttggggagccgcaaccgcgtcttatcagatcgaaggcgcatggaacgaggatggcaaaggcgaatccatttgggatcgcttcagccatacgcccggaaaggtcaccaatgccgataccggtgacatcgcctgtgaccactatcaccgttgggaggaagatatcgcccttatgcgccaacttgggttgaaggcgtaccgcttttccacttcatggccccgtgtgatcccggcgggccgcagacgggtgaatgtcaaagggctggatttctacgatcgcctggtggatggtctgtgcgccgcgaacatcgaaccgttcctcaccctgtatcactgggacctgccgcaggctcttcaagacgaaggcggctgggataatcgcaacaccgcccatgcctttgccgattatgccgcattgatggtgaaacgacttggcgaccgtatccgctattggacgacgttcaacgaacccagcgttgtggcgttcaatggtcattactcaggctcgcacgccccgggcattcaagatgcccgtgttacccgccaggtggtgcatcatttgctggtggcgcatgggttggctgtgcaggcgatccgcggcgcaaactccaaagtggatgtgggcatcgtgcttaatttatggcccgccgaacccgattcggactcccccgaagatgccgccgccgccgaagccgcctggaaccggcacgagaccctgttccttgaccccatctttaaggcgcattatcccgtatctgcccttgatgcgattggggaggatatgccccgcatccacgacggcgatctggcgttgatctctcaggaattggattttgtcggcatcaactattactcccgccatgtggtcagtgccacaaaagaaataggcaggcttcccgaatcggaatacactgaaatgggctgggaagtatgcgcccccgcactccgccgcctgctggtcaagatccataacgattaccgtttgccgcccatctatatcaccgaaaacggatcggcattcaaggacgaagttaacgcagacggaaaggttcatgacccgcggcggttggattacctgaaacaacacctgattcaactttgccttgccatgcaggacggcgtggatgtgcgcggctacatggcttggtccctgctggataatttcgagtggggtcacggcttttccaagcgctttggcttggtccatgtggattacgagagccagaagcggattattaaagactcgggtgaatggtatgcaagtgtgatacggaagaacgaggttgttgaataa

SEQ ID NO: 350 - protein, 440 aa, Unknown
  Obtained from environmental sample
  DOMAIN (2)...(438): Glycosyl hydrolase family 1
  SITE (10)...(24): Glycosyl hydrolases family 1 N-terminal signature. Prosite id = PS00653
  SITE (351)...(354): N-glycosylation site. Prosite id = PS00001
MSTYKFPHNFFWGAATASYQIEGAWNEDGKGESIWDRFSHTPGKVTNADTGDIACDHYHRWEEDIALMRQLGLKAYRFSTSWPRVIPAGRRRVNVKGLDFYDRLVDGLCAANIEPFLTLYHWDLPQALQDEGGWDNRNTAHAFADYAALMVKRLGDRIRYWTTFNEPSVVAFNGHYSGSHAPGIQDARVTRQVVHHLLVAHGLAVQAIRGANSKVDVGIVLNLWPAEPDSDSPEDAAAAEAAWNRHETLFLDPIFKAHYPVSALDAIGEDMPRIHDGDLALISQELDFVGINYYSRHVVSATKEIGRLPESEYTEMGWEVCAPALRRLLVKIHNDYRLPPIYITENGSAFKDEVNADGKVHDPRRLDYLKQHLIQLCLAMQDGVDVRGYMAWSLLDNFEWGHGFSKRFGLVHVDYESQKRIIKDSGEWYASVIRKNEVVE

SEQ ID NO: 351 - DNA, 1389 bp, Unknown
  Obtained from environmental sample
atgagcgctccgagtcccgcccgccccgtgtcctttcctccccgcttcgtgtggggagccgcggccgcatcctatcaaatcgagggcgccgtccgggaggacggcaagggcccttcggtgtgggacatgttctgcgagaagccgggagccgtcttcgaggggcacgacggggcggtggcttgcgatcactaccaccgttaccgggaagacgtggccctgatgcggcagattgggctccaggcttaccgcctgagcgtgtgctggcccagggtgctgcccgaggggaccgggcagcccaacgagaaggggctcgacttctactcccggctcgtcgacgccttgctcgaggcggggatcacgccttgggtcaccctttttcactgggactacccactagccctatatcaccggggaggctggctcaatcgggatagctcagactggttcggcgagtacgcgggtctgattgcggagcgcctctccgatcgggtgagccacttcttcacccagaacgagccccaggtgtacatcggcttcgggcacctcgaggggaaacacgcgccgggcgatacccttcccctgtcgcagatgctgctggccggtcaccacagcctgctcgcccatggaaaggccgtgcaggcgctgcgcgcccacggcaagcagcagctgcgggttggatacgctccggtggggatgccgctgcatccggtcagcgagtccgccgaagacgtggcggctgcacgcaccgccactttccgcgtccgagagaagaattcctggaacaacgcttggtggatggacccggtgtacctcggtgagtaccccgcccaagggctcgagttctacgggcgagacgtccccgcgatccggtccggagacatggaactcatccggcaacccttggactttttcggcgtcaacatctaccagagcacgcccgtgcgcgccgcgggggcgccccaggggttcgaggtcgtccggcatccgacgggccaccccatcaccgcgttcaactggccggttacgccacaggccttgtattgggggccgcggttcttctacgagcgctatggcaagcccatcgtcattacggaaaacgggctttcctgccgagacgtgatcgcccttgacggcaaggtgcacgatccgtcccgcatcgacttcaccacgcgctacctgcgcgagctccaccgcgccatcgccgaaggcaacgaggtggagggctacttccactggtccatcatggacaacttcgaatgggctgccggataccgagaacgcttcgggctcgttcacgtggattacgagaccctggtgaggacacccaaggactctgcggcgtggtaccgccaggtcatccagagcaacggggccgtgctgttcgattga

SEQ ID NO: 352 - protein, 462 aa, Unknown
  Obtained from environmental sample
  DOMAIN (8)...(458): Glycosyl hydrolase family 1
  SITE (16)...(30): Glycosyl hydrolases family 1 N-terminal signature. Prosite id = PS00653
  SITE (366)...(374): Glycosyl hydrolases family 1 active site. Prosite id = PS00572
MSAPSPARPVSFPPRFVWGAAAASYQIEGAVREDGKGPSVWDMFCEKPGAVFEGHDGAVACDHYHRYREDVALMRQIGLQAYRLSVCWPRVLPEGTGQPNEKGLDFYSRLVDALLEAGITPWVTLFHWDYPLALYHRGGWLNRDSSDWFGEYAGLIAERLSDRVSHFFTQNEPQVYIGFGHLEGKHAPGDTLPLSQMLLAGHHSLLAHGKAVQALRAHGKQQLRVGYAPVGMPLHPVSESAEDVAAARTATFRVREKNSWNNAWWMDPVYLGEYPAQGLEFYGRDVPAIRSGDMELIRQPLDFFGVNIYQSTPVRAAGAPQGFEVVRHPTGHPITAFNWPVTPQALYWGPRFFYERYGKPIVITENGLSCRDVIALDGKVHDPSRIDFTTRYLRELHRAIAEGNEVEGYFHWSIMDNFEWAAGYRERFGLVHVDYETLVRTPKDSAAWYRQVIQSNGAVLFD

SEQ ID NO: 353 - DNA, 1098 bp, Unknown
  Obtained from environmental sample
atgactcggaggtctatcgtgcgttcttcttccaacaagtggcttgtccttgccggtgcggcgctgctcgcctgcaccgccctcgggtgcaagaaaaaaggcgagagcggtgacgtcgcctcggccccggggcaggcccaggcgggcggcaagcagccgtttcccgacgatgcgccgatcaccgaaccgcccgctccgccccctcgtagcggcaatcctctggtgggcgccaagctcttcgtcgacccggaatctttggccatgttgcaggcgaacaagctgcggcgcaccgacccggagaaggcggcgattttggatcgcatcgcccagcagccccaggctttgtggatgggcgagtggaacacgaacatcttccgcgcggtcgagcatttcgtggctcgcgccaaggcggagggcgccgtgcccgtcatgatcgcctacaacatcccccaccgcgactgcgggcagtactctcagggtgggctttcctccaaggaggcttaccagcgctggattcggaacgtcgccgcggggattggcagcgatgcagcggtcgtcgtgctcgagcccgacgcgctcggccacttccaggagtgtttgaccgaggagcagagcgccgagcgcatgttcctgctcagcgacgccgtcaaggtgctgcgccaaaatccgaagacggccgtgtacctggatgccgggcacgcgcgctgggtgccggtggaggagatggccgagcgcctcaagctcgcgggcatcgagcacgcccatggcttttcgctcaacacctcgaactacgtgggcaccgaggagaacgccgcttacggccacaagctcgtcgaggccctgggtgggaacgtgcgcttcgtcatcgacacgagccgcaatggggcgggcccctacgaggaggccaagaacgccgaggagagctggtgcaacccgcccggtcgcaagatcggcaagccgccgaccaccgagacgggggatcccctcatcgacggattcctttggctgaagcgcccgggcgagtcggacggtcagtgcaacggcgggcccaaggccggtgtgttctggctggagcaggctctccagcaggcccagtaa

SEQ ID NO: 354 - protein, 365 aa, Unknown
  Obtained from environmental sample
  SIGNAL (1)...(29)
  DOMAIN (81)...(358): Glycosyl hydrolases family 6
  SITE (187)...(196): Glycosyl hydrolases family 6 signature 2. Prosite id = PS00656
  SITE (263)...(266): N-glycosylation site. Prosite id = PS00001
MTRRSIVRSSSNKWLVLAGAALLACTALGCKKKGESGDVASAPGQAQAGGKQPFPDDAPITEPPAPPPRSGNPLVGAKLFVDPESLAMLQANKLRRTDPEKAAILDRIAQQPQALWMGEWNTNIFRAVEHFVARAKAEGAVPVMIAYNIPHRDCGQYSQGGLSSKEAYQRWIRNVAAGIGSDAAVVVLEPDALGHFQECLTEEQSAERMFLLSDAVKVLRQNPKTAVYLDAGHARWVPVEEMAERLKLAGIEHAHGFSLNTSNYVGTEENAAYGHKLVEALGGNVRFVIDTSRNGAGPYEEAKNAEESWCNPPGRKIGKPPTTETGDPLIDGFLWLKRPGESDGQCNGGPKAGVFWLEQALQQAQ

SEQ ID NO: 355 - DNA, 1347 bp, Unknown
  Obtained from environmental sample
atgactgaccatcgttttccaaaaggattcatctggggaaccgctacggcgtctttccagattgaaggcgccacccgcgaagatggccggggcgaatccatctgggaccgcttctgcgccacgccggggaaaattgtcacgggcgaaaccggcgatcctgcctgcgactcctatcatcgttaccctgaagacatcgccctgatgaaggctatgtcgctcaatggttaccgcttttcaatcgcctggcctcgcgtcattcctgacggagacggtaaagtctgtcaggccgggctcgactactacgatcgtgtggtagatgctctcctggcggagaatatccaaccttttatcaccctgtaccactgggacctgccccaggcattacaggatcggggtggctggggcaaccgtgccacggttgaggcgttcactcgctacgtagatattgtggtttctcgcctgggtgaccgcgtaaagtactggatgacacacaacgaaccctggtgtgtatccattttgagccatgagcttggtgaacatgcccccgggttgaaggaccgaaaactggccctccaggtggcgcaccatgtcctcgtttctcacggcctggccgtgcccatcatccgccagcgttgtaaagaggcgcaggttggcatcgtgttgaatttttcacctgcttacccggccaccgatagcctggccgaccagatggccacccgtcagcaccacgcccggtttaacctctggttcctcgatcccatcgccgggcgcggctacccgcaggatgcctgggaagggtacggagccgatgttcccgccatgaggcctgatgacatgcagatcatcgccgcccccatcgacttcctgggcgtcaatttctacagtcgggcggtctgccacgatccggccgggggcgaaggttcccgggtgctcaatgtgcgcagtaaaaccgaggccaccgatcgagactgggagatttaccctcaggcgctctacgatttactcatctggatccacaatggataccagttcagagatatttacattaccgagaatggcgcctcatacaacgatgtggtctccccggatgggaaagtgcacgatcctaaacgtctggactatctgaaacgccatctggccatggctctgcgggccatcgaagcgggcgttccactgcgtggttatttctgctggagcttgatggacaacttcgaatgggccatgggcaccagcagccgattcgggttggcctacaccgacttcactacccagaagcgtattctcaaagacagtgggctctggtttggcgaagtggcacgggcaaacgccttaatcgaccttccctga

SEQ ID NO: 356 - protein, 448 aa, Unknown
  Obtained from environmental sample
  DOMAIN (2)...(444): Glycosyl hydrolase family 1
  SITE (10)...(24): Glycosyl hydrolases family 1 N-terminal signature. Prosite id = PS00653
  SITE (352)...(360): Glycosyl hydrolases family 1 active site. Prosite id = PS00572
MTDHRFPKGFIWGTATASFQIEGATREDGRGESIWDRFCATPGKIVTGETGDPACDSYHRYPEDIALMKAMSLNGYRFSIAWPRVIPDGDGKVCQAGLDYYDRVVDALLAENIQPFITLYHWDLPQALQDRGGWGNRATVEAFTRYVDIVVSRLGDRVKYWMTHNEPWCVSILSHELGEHAPGLKDRKLALQVAHHVLVSHGLAVPIIRQRCKEAQVGIVLNFSPAYPATDSLADQMATRQHHARFNLWFLDPIAGRGYPQDAWEGYGADVPAMRPDDMQIIAAPIDFLGVNFYSRAVCHDPAGGEGSRVLNVRSKTEATDRDWEIYPQALYDLLIWIHNGYQFRDIYITENGASYNDVVSPDGKVHDPKRLDYLKRHLAMALRAIEAGVPLRGYFCWSLMDNFEWAMGTSSRFGLAYTDFTTQKRILKDSGLWFGEVARANALIDLP

SEQ ID NO: 357 - DNA, 1404 bp, Unknown
  Obtained from environmental sample
atgaatcattccctttcatttccgccatcctttgtatggggcgcggcaaccgcaagctaccaactggaaggatcaacccaaggcgtggacggctgcgccgagtccgtctgggatatgcactgccgaagatccggcgcgatcaaggacggctcgaacggattcgtcgcctgcgatcactaccatcgctatcgcgaggatgtggcgctcatgaacgagcttggcttgaatgcctatcgattctcaatcatgtggccccgcgtcatgcccgaaggcaccggcgcggtgaacgagaagggcatggatttctacgatcggttggttgatgaactgctcgccgccggcatcacaccttgggttactttgttccactgggactttcccctagccttgttccaacgcggtggctggctgaatgcggattccccgcaatggtttgaggattacactcgggaagtggttaaacgcttgtcggatcgtgtgcatcactggctaacgctcaacgaaccggcgtgcttcattgagtttggccaccgtaccggcatgcatgcacccggcttgcaactggcggacaaggaagcctgccgggtctggcaccatgccatgctggcccacggtcgcgccgttcgcgctattcgccaggaatccgtgcatccatcaccccaggtcggctacgcgccggtcttccgcactaccatcccggacactgaagatcctgccgacatcgaagcggcccggacctcgatgtttgctcatcaggccggcaacctgttcgatacgcggtggaacctcgacccctgctttcggggcgcgtatccggagatcatgatgcagtattggggcgatgccgcgccgcgcatccaggacggcgacatggagttgatccgtcaggaactcgattttctcggcctgaatatttaccagtccgagcgcattcgggccggtgcggatggcgcacccgaggtggtgccataccctgcggattatccgcgcaaccagctcggttggcccatcacgccggaggccctgcgctgggcgaccctctttctctttgaggagtacgggaaacccctgatcatcacagaaaacggaatcaccctcgacgacaagcccaatgcagacggcgaggtgaatgatgtccagcggatcgcttttctgaatgactatcttagcggtctccagcgcagcgtggacgacggcatccctgtactgggctatttccactggtcgctgtgcgacaactttgagtgggcagaaggctatgtccctcgcttcggcctgatccatgtggactatgccagtcaacgcagaaccatcaaggcctcaggacggttttaccgcgacatcattcggggccagacagccacgccctgcatcgcccaatccagtcagccggaaacaacctaa

SEQ ID NO: 358 - protein, 467 aa, Unknown
  Obtained from environmental sample
  DOMAIN (3)...(454): Glycosyl hydrolase family 1
  SITE (2)...(5): N-glycosylation site. Prosite id = PS00001
  SITE (11)...(25): Glycosyl hydrolases family 1 N-terminal signature. Prosite id = PS00653
MNHSLSFPPSFVWGAATASYQLEGSTQGVDGCAESVWDMHCRRSGAIKDGSNGFVACDHYHRYREDVALMNELGLNAYRFSIMWPRVMPEGTGAVNEKGMDFYDRLVDELLAAGITPWVTLFHWDFPLALFQRGGWLNADSPQWFEDYTREVVKRLSDRVHHWLTLNEPACFIEFGHRTGMHAPGLQLADKEACRVWHHAMLAHGRAVRAIRQESVHPSPQVGYAPVFRTTIPDTEDPADIEAARTSMFAHQAGNLFDTRWNLDPCFRGAYPEIMMQYWGDAAPRIQDGDMELIRQELDFLGLNIYQSERIRAGADGAPEVVPYPADYPRNQLGWPITPEALRWATLFLFEEYGKPLIITENGITLDDKPNADGEVNDVQRIAFLNDYLSGLQRSVDDGIPVLGYFHWSLCDNFEWAEGYVPRFGLIHVDYASQRRTIKASGRFYRDIIRGQTATPCIAQSSQPETT

SEQ ID NO: 359 - DNA, 1101 bp, Unknown
  Obtained from environmental sample
atgagaaatcatctgaatgtacccttttactttatcttcttttttttaatagcgtcaatatttacagtctgttcatcatcaactgcttctgataacaatgagcatccaccgccagtggaagtcgcggatcaggacgcttttcgtgatgcttttgaagtgaatgaattacttggacgcggtattaatctgggtaatgcccttgaagcgcccaatgaaggcgaatggggaatggtaatccaggaagagtttcttgatctgatacttgcagcaggttttgagtctgtacgaattccgattcgctggaatgcccatgccagtgaaagtcaccctttcaccattcaacgatcgttttttgatcgggttgatgaagtcatccaatggtcgctggatcgtggcctttctgtaatgatcaatattcatcactacaatgaactgatgcaaaacccgcagcagcaccggcagcggtttttgcgactctggaaccagattgctacacactataaagattatccggataatctggtttttgaaatccttaatgaacctcatgataatctgactccttctatctggaatagttatttgagggatgctattggcatgattcgccagacaaacccacgcagggttatcgctatcggaacagcaaactggggtggtttcggagcattatcacaacttgaaatcccctcaaacgatcgccagatcattgcaactgttcattattatgaacccttcaggttcacccatcagggggctgaatgggcaggaccggaaacaaacgattggctggggacacgatgggatggatcggatgaggaaaaatttgatattgaaagtggttttgatgccgtacagtcctgggcagtgacaaataaccggcctgttcatctcggagaattcggtgcttacagtactgccgataatgaatcacgcgaacgctggacaacctttgttcgggaatccgctgagcaacgcaatttcagctgggcatactgggaatttgcagccggttttgggatctatgaccgtaatcagtggcaatggagggattatctgttgagggctttgataccggatagcccggtcctgttggagtaa

SEQ ID NO: 360 - protein, 366 aa, Unknown
  Obtained from environmental sample
  SIGNAL (1)...(29)
  DOMAIN (64)...(342): Cellulase (glycosyl hydrolase family 5)
  SITE (176)...(185): Glycosyl hydrolases family 5 signature. Prosite id = PS00659
  SITE (313)...(316): N-glycosylation site. Prosite id = PS00001
  SITE (332)...(335): N-glycosylation site. Prosite id = PS00001
MRNHLNVPFYFIFFFLIASIFTVCSSSTASDNNEHPPPVEVADQDAFRDAFEVNELLGRGINLGNALEAPNEGEWGMVIQEEFLDLILAAGFESVRIPIRWNAHASESHPFTIQRSFFDRVDEVIQWSLDRGLSVMINIHHYNELMQNPQQHRQRFLRLWNQIATHYKDYPDNLVFEILNEPHDNLTPSIWNSYLRDAIGMIRQTNPRRVIAIGTANWGGFGALSQLEIPSNDRQIIATVHYYEPFRFTHQGAEWAGPETNDWLGTRWDGSDEEKFDIESGFDAVQSWAVTNNRPVHLGEFGAYSTADNESRERWTTFVRESAEQRNFSWAYWEFAAGFGIYDRNQWQWRDYLLRALIPDSPVLLE

SEQ ID NO: 361 - DNA, 1284 bp, Unknown
  Obtained from environmental sample
gtgaacaccgcgcatcgcatcgaattccctcggcaatttatcttcggttccgccactgctgctcaccaagtggagggcaacaacgttcacaatgattggtgggcccacgagcatgccaccgacacgaatgccgtggagccgtcgggcctcgcctgcgaccactttcggcgctttgccgacgacttccgcctcttacgccaactcggacagccagcgcaccgcctgtcgctggaatggagccgcatcgaaccggcacccggtgaaatcgatcgttcggcattgtcccactaccgccgagtcctgggtactttgcgagacctcggaatcgagccatgggtcaccatccaccacttcacttgccctcgctggttcgtggaacagggagggtttacacgcatggattcagcgcgctctctcgttcgccataccgaacgcgtggcgagggagttctccgacctagtcacaaactggtgcaccataaatgagccaaacgtcgtggcagaactcggttatcgcttcggatactttccgccgcggttgcaggacgatgagctggcagcggaagtgctcaccaacttctttcgcttacacgctgaaatggcagaagttttgcgcgctcacgcgcagagatcggcgcaaatcggtatcacccttgcgatgcaagcacacgagccgctgcgcatcgaaagcgaagcggaccgcgcactggcggcgcggcgcgacgccgagaccaacggcgtcatgctcaacgccttgcgaaccggtgtattcgcctacccgggacgggagccggtggaaatccctggactgaaaacgtcatcgaccttcgtgggggtccagtactattcgcgggtccgctacgacgccgagtcgcaaggtccagcaatgcccgacttcgagcgcaccctcagccaaatgggatgggaggtgtatcctgaggggttcggccccttgctcgagcgcgcagcagaaactggactcgaagtgatcgtcacagagaacgggatggcgcacgacgatgaccgtgtgcgcgtgcgttttatcgccgaccacttgcgggtcgttcaccgccttctggaacgcggtgtgcgcatcggagggtacttttactggtcgaccatggacaacttcgaatggaacttcgggtacggaccgaagttcggcctgatcgaagtggaccgttctaccctggaacgcaggccgcggcgaagcgcgtatttcttccgtgacatgatccagcagcgagtgctcgacgacgacctggtcgagcactggactcgctga

SEQ ID NO: 362 - protein, 427 aa, Unknown
  Obtained from environmental sample
  DOMAIN (5)...(417): Glycosyl hydrolase family 1
  SITE (334)...(342): Glycosyl hydrolases family 1 active site. Prosite id = PS00572
MNTAHRIEFPRQFIFGSATAAHQVEGNNVHNDWWAHEHATDTNAVEPSGLACDHFRRFADDFRLLRQLGQPAHRLSLEWSRIEPAPGEIDRSALSHYRRVLGTLRDLGIEPWVTIHHFTCPRWFVEQGGFTRMDSARSLVRHTERVAREFSDLVTNWCTINEPNVVAELGYRFGYFPPRLQDDELAAEVLTNFFRLHAEMAEVLRAHAQRSAQIGITLAMQAHEPLRIESEADRALAARRDAETNGVMLNALRTGVFAYPGREPVEIPGLKTSSTFVGVQYYSRVRYDAESQGPAMPDFERTLSQMGWEVYPEGFGPLLERAAETGLEVIVTENGMAHDDDRVRVRFIADHLRVVHRLLERGVRIGGYFYWSTMDNFEWNFGYGPKFGLIEVDRSTLERRPRRSAYFFRDMIQQRVLDDDLVEHWTR

SEQ ID NO: 363 - DNA, 1386 bp, Unknown
  Obtained from environmental sample
atgtcgtttccgagaaatttcctgtggggatcagccacctcctcctaccaaatcgaaggcgcctggcaagaagacggcaaaggcccaaatatctgggacgtgttttcacacaccccggggaaagtcgccaatggcgacaccggtgatatcgccatcgaccactaccaccgataccgagacgacgttgccctgatggctgagcttggacttcaggcataccgtttctcgttctcctgggccagaataatgccggaaggagcaggccccatcgagcaacggggtctggacttctacgaccgcctcattgatgcactgctggagaaaaacatccaacccatggccaccctctaccactgggatttaccagccgcactgcaagacagaggggggtggactaaccgcgacagcgcgtcctggtttgctgactactcagccgttgttcacgacgctttttctgaccgggtgggaatgtgggcaacgttgaacgagccgtgggtgtctgcatttttgggccacggaactggcatccacgcacctggcatcacaagcccccacgcggcgttcgccgcggggcatcacctgcttctggggcatggcaaggccatccaagcgatgcgcgctcaatcgtctagcacccaactgggaattgttttgaacctcgcccccgtgtatctcgaaggtgacacccctgctgaccacccggctcacacctccgtggcactacacgatgccattttgaatgggttgtggacagagccgcttctgcgctccagataccccgacctgcttcttcaactaggcgacatggtgacaaaaaacatccacgacggtgacctcgccatcatggccgagccgattgactggatgggcatcaactactaccaggacattagatttgtggccactgatgttgcccccacggctaacccgatggcccctccgggtaacgacctgccgggcaccgtcggggtggagcctgcgccagcaatcggaaacatcaccagctttggctggtccaccacccccgacggactgcgagtactgttggtgggcctggatgaggaatacgacaacctcccgccgatattcattaccgaaaacgggtgtgcttacgattaccccgtcgaggacggtgtcgtcaacgacacccttcgtgtcacatacatgcgagaacacctcaccgcgttgtcgcaggccattgaggcgggtgtgaatgtccggggctatatgcactggtctctgttcgacaacttcgagtgggccgaagggtatcgccaacgctttggcatggtgcacgtcgactttgagaccttggagcggactcccaaagcctcagctcactactattcacgtgtcatcacaaataacgccctctctgacgactga

SEQ ID NO: 364 - protein, 461 aa, Unknown
  Obtained from environmental sample
  DOMAIN (1)...(458): Glycosyl hydrolase family 1
  SITE (7)...(21): Glycosyl hydrolases family 1 N-terminal signature. Prosite id = PS00653
  SITE (337)...(340): N-glycosylation site. Prosite id = PS00001
  SITE (386)...(389): N-glycosylation site. Prosite id = PS00001
MSFPRNFLWGSATSSYQIEGAWQEDGKGPNIWDVFSHTPGKVANGDTGDIAIDHYHRYRDDVALMAELGLQAYRFSFSWARIMPEGAGPIEQRGLDFYDRLIDALLEKNIQPMATLYHWDLPAALQDRGGWTNRDSASWFADYSAVVHDAFSDRVGMWATLNEPWVSAFLGHGTGIHAPGITSPHAAFAAGHHLLLGHGKAIQAMRAQSSSTQLGIVLNLAPVYLEGDTPADHPAHTSVALHDAILNGLWTEPLLRSRYPDLLLQLGDMVTKNIHDGDLAIMAEPIDWMGINYYQDIRFVATDVAPTANPMAPPGNDLPGTVGVEPAPAIGNITSFGWSTTPDGLRVLLVGLDEEYDNLPPIFITENGCAYDYPVEDGVVNDTLRVTYMREHLTALSQAIEAGVNVRGYMHWSLFDNFEWAEGYRQRFGMVHVDFETLERTPKASAHYYSRVITNNALSDD

SEQ ID NO: 365 - DNA, 1266 bp, Unknown
  Obtained from environmental sample
gtggaaaaggaaggctttctctttggcgcggccaccagcgcctaccagatcgaaggggccacgggggaggatgggcgagggccttccatctgggacgttttctgccaacgccccggggccatccgggatgggagctcgggcgaacccgcctgcgaccattaccgccgttggcgcgaggacctgcagtggatgcgttggctgggcctaaaggcctaccgtttctccgtggcctggccccgcatcctccccgggggaaaggggcgcatcaacccgaagggcctcgccttctacgaccgcctcgtggacgccctcctggaagcggggatcacccccttcctcaccctctaccactgggacctcccctgggccttggaggaacggggcgggtggcggagccgggagaccgcctacgccttcgccgagtacaccgccttggtggcccgggccctggccgaccgcgtcccctacttcgccaccctcaacgagccctggtgcagcgccttcctgggccacttcacgggcgagcatgcccccgggctccggaacctcgaggccgccctccgcgccgcccaccacctcctcctgggccacggcctggccgtggaggccttgcgggccgccggggccaagcgggtgggcatcgtcctgaacttcacctgggtggagggggaggacgaggaagcggtggagcgggcggaccgctaccacaaccgtttcttcctggaccccctcttgggccggggttaccccgaaagccccttcgccaacccacccagcgtccccatctatcccaaggacctggagcgcatggcaaggcccctggacttcctcggggtgaactactacacccgggcccgggtggcccggggggaaggcctcttgccggtgcgctacctgcccccggaaaggcccaccacggccatgggctgggaggtctaccccgaggggctctaccgcctcctgaggcgcctggcccgggaaaccccttggcccctcttcgtcacggaaaacggggccgcctacccggacctttggcgaggggaagaggtggtggaggaccccgagcgggtggcttacctggaaagccacctggaagcggtgggtagggcgcggagcgaaggcgtagacgtcagggggtacttcgcctggagccttctggacaactttgagtgggcccacggctacaccaagcgcttcgggctcctctacgtggactatcccacgggacggcgcatccccaagcggagcgccctctggtaccgggag

SEQ ID NO: 366 - protein, 422 aa, Unknown
  Obtained from environmental sample
  DOMAIN (1)...(422): Glycosyl hydrolase family 1
  SITE (6)...(20): Glycosyl hydrolases family 1 N-terminal signature. Prosite id = PS00653
  SITE (220)...(223): N-glycosylation site. Prosite id = PS00001
  SITE (337)...(345): Glycosyl hydrolases family 1 active site. Prosite id = PS00572
MEKEGFLFGAATSAYQIEGATGEDGRGPSIWDVFCQRPGAIRDGSSGEPACDHYRRWREDLQWMRWLGLKAYRFSVAWPRILPGGKGRINPKGLAFYDRLVDALLEAGITPFLTLYHWDLPWALEERGGWRSRETAYAFAEYTALVARALADRVPYFATLNEPWCSAFLGHFTGEHAPGLRNLEAALRAAHHLLLGHGLAVEALRAAGAKRVGIVLNFTWVEGEDEEAVERADRYHNRFFLDPLLGRGYPESPFANPPSVPIYPKDLERMARPLDFLGVNYYTRARVARGEGLLPVRYLPPERPTTAMGWEVYPEGLYRLLRRLARETPWPLFVTENGAAYPDLWRGEEVVEDPERVAYLESHLEAVGRARSEGVDVRGYFAWSLLDNFEWAHGYTKRFGLLYVDYPTGRRIPKRSALWYRE

SEQ ID NO: 367 - DNA, 1374 bp, Unknown
  Obtained from environmental sample
atgaccaccatgcataacgacgataccgacaccagctttcccgccaccttcacctggggcgtggccaccagcgcctaccagatcgaaggcgccgccgccatcggcggccgcggcccgtccatctgggataccttcagccacacggaaggcaagatcatcgacggcagcaatggcgacgtggcctgcgaccactaccaccgctatgccgaggacgtggagctgatcgccagcctgggcgtgaacgcctaccgcttttccatgtcctggtcgcgcgtccagcccacgggttccggcgcctggaacgaagcaggctttgatttctatgcccgcctgctcgacgccctggccgccaagggactcgacgcgcacctgaccctgtaccactgggacctgccgcaagccttgcaggacgagggcggctggctcaatcgcgccacctgctaccacttcgccgcgtatgccgccgaggtggcgcgccgcttcggccacaaggtcgccagcatcgccacgcacaatgagccgtggtgcactgccgtgctgggccacggcaccggccagttcgcgcccggcatggccgatccggccgccgccgtgcaggtgtcgcaccacctgctgctgtcgcacggcctggccatgcaggcgatgcgcacggtgaacgcgccggcaaagctgggcatcgtgctcaatcagtggacggccacgccagccaccgacagcgcgcaggaccgcgagctggccgaactcgaatatgcgcgctcggtgcagtggtatatggacgccatcttcaagggccgctacccggccctggctctgaaacacatcgacgcacaagctttatccatctttgaaaacgatttcatagatatcaagcaacccatcgatttcctcggcgtgaactactacacgcgcgccttcatgagcgccgagacgccgccgcgcaagcctgaatgcaagctcggcgtcaacgacatgggctgggaaacctatccgcagggcttgacggaactgctcgtcggcctgcaccgcgagtaccgcctgccgcccgtctacatcacggaaaacggcatggccgtggccgacaagcccgtcgacggcaaggtgcacgacgaaccgcgcatcgagtacgtgcggctgcacctggacgccttgcgcgccgtggtcgcgcagggcatcgacgtgcgcggctatttctactggagcctgatggacaacttcgagtggaactcaggctacgccaagcgcttcggcatgctgtatgtcgactacgccacgcagcagcgcagcttcaaggacagcgccctgtggtaccgcgacttcatcgccgcgcagcgggccgcgcacgctgatgcgccggcgctggcggaggggaactga

SEQ ID NO: 368 - protein, 457 aa, Unknown
  Obtained from environmental sample
  DOMAIN (9)...(445): Glycosyl hydrolase family 1
  SITE (17)...(31): Glycosyl hydrolases family 1 N-terminal signature. Prosite id = PS00653
  SITE (354)...(362): Glycosyl hydrolases family 1 active site. Prosite id = PS00572
MTTMHNDDTDTSFPATFTWGVATSAYQIEGAAAIGGRGPSIWDTFSHTEGKIIDGSNGDVACDHYHRYAEDVELIASLGVNAYRFSMSWSRVQPTGSGAWNEAGFDFYARLLDALAAKGLDAHLTLYHWDLPQALQDEGGWLNRATCYHFAAYAAEVARRFGHKVASIATHNEPWCTAVLGHGTGQFAPGMADPAAAVQVSHHLLLSHGLAMQAMRTVNAPAKLGIVLNQWTATPATDSAQDRELAELEYARSVQWYMDAIFKGRYPALALKHIDAQALSIFENDFIDIKQPIDFLGVNYYTRAFMSAETPPRKPECKLGVNDMGWETYPQGLTELLVGLHREYRLPPVYITENGMAVADKPVDGKVHDEPRIEYVRLHLDALRAVVAQGIDVRGYFYWSLMDNFEWNSGYAKRFGMLYVDYATQQRSFKDSALWYRDFIAAQRAAHADAPALAEGN

SEQ ID NO: 369 - DNA, 1620 bp, Unknown
  Obtained from environmental sample
atgtttaaaaattattttatacttaacagacttgttgtagaattaaacaaagaagtaaaagactttgaagtaattcgtgcattttcctacgaaaaagataaaattgcttttattctcaggaaaaagctagatgaattaagtattgaaatatcagttaatccgggatttccatatttaagtttgcgaaatagattttcaattccacgaaaaaaccttgttgatttctttagttcatacttacccctaaaaattatttcatttggaatttcagatagagatagagtcataaaaataaatctggataaagcatccatttattttacaatcagaggaaaatatactaatgtctttttaatatcgaatgaagctgaaatggagaactttaaaaaaaccgatgaatcagttttaaaagacttcaaatatgaagctgagaatcagcattttattcatgaatttaacgaattgcaatttattgaaaagtttgttgaacctgagttagttagaaagaaatatccaatcattggtaaagaaataattaatgaagtaaaaattagagcagaaaatgctgatgtctccacatctctgttattaaaagtaatcactgaagtaaatgaaaaagatcctgctgtttttattgatgagaatacaaatgaagttaatttaggaattgaaacgtttaatgtatttccattcaccaaaaaagaaatattttcaaacctgattgaagcatttaattattttcttaatcagaaattttccagagaaagtatttttgataaaaagaagataattgaaaagtatcttgagaatggattaaataaagtctcagctaaattaaatgatgttcaatccagaattcaaaggggtacgaaagaggaagagtataataaaatagctaatcttcttttaatcaatattaataattttactaaaggtaagaatagtgttgaactacaggatatttataaagagaattccttcgtttcaataaaattggatactaaattatctccaaagcaaagtgttgattcatattttgaaaaagcaagaaacgaaaaaataaaatttgaaaaatccaggcagctctactccgagcatcagaaaaaatattctgaattacaaaggattaaaggaaaatttttaaaagctaaaataacagaagaatatgatttaattatgaaagaattaaatattaagcaggaagtaaaaaccaaacctcaggatgatttaaaggataaattcagacattatttagtccacaagaaatacaatgtttatgtaggaaaagacagcaaaagtaatgatctcttaactatgaaatttgcaaaacagaatgattattggtttcatgccagagggctttcagggtctcacgtagttcttaagaatgaaaatgctaaagaaggaataccaaaaaatatattaaaagctactgcatcattggcagcctatcatagtaaagcaaaaaccgcaggaatggcacctgtttcttacacacaaaaaaaatatgtaataaaaaagaaaggtatggaacccggcaaagttgccttgctgaaagaagaggttttaatcgttaagccggtaattcctgtagagtgcgagtatattagtgttgaatga

SEQ ID NO: 370 - protein, 539 aa, Unknown
  Obtained from environmental sample
  DOMAIN (1)...(406): Fibronectin-binding protein A N-terminus (FbpA)
  DOMAIN (417)...(506): Domain of unknown function (DUF814)
  SITE (312)...(315): N-glycosylation site. Prosite id = PS00001
  SITE (329)...(332): N-glycosylation site. Prosite id = PS00001
MFKNYFILNRLVVELNKEVKDFEVIRAFSYEKDKIAFILRKKLDELSIEISVNPGFPYLSLRNRFSIPRKNLVDFFSSYLPLKIISFGISDRDRVIKINLDKASIYFTIRGKYTNVFLISNEAEMENFKKTDESVLKDFKYEAENQHFIHEFNELQFIEKFVEPELVRKKYPIIGKEIINEVKIRAENADVSTSLLLKVITEVNEKDPAVFIDENTNEVNLGIETFNVFPFTKKEIFSNLIEAFNYFLNQKFSRESIFDKKKIIEKYLENGLNKVSAKLNDVQSRIQRGTKEEEYNKIANLLLININNFTKGKNSVELQDIYKENSFVSIKLDTKLSPKQSVDSYFEKARNEKIKFEKSRQLYSEHQKKYSELQRIKGKFLKAKITEEYDLIMKELNIKQEVKTKPQDDLKDKFRHYLVHKKYNVYVGKDSKSNDLLTMKFAKQNDYWFHARGLSGSHVVLKNENAKEGIPKNILKATASLAAYHSKAKTAGMAPVSYTQKKYVIKKKGMEPGKVALLKEEVLIVKPVIPVECEYISVE

SEQ ID NO: 371 - DNA, 2265 bp, Unknown
  misc_feature: Thermococcus AEPII1a DNA
gtgagcagtaagcaaaagactgtggcaatatttgttttgtttgttgctttggcgggagtagccggaagcattcctgcaagctatgcagcgccaagcaccagcacgtacacgacgcccacgggaatatactatgaagtcagaggagatacaatctacatgataaacgttgcaacgggagaggagaccccaatacacctctttggagtcaactggttcggctttgagacaccgaactacgttgttcacggcctatggagtaggaactgggaggacatgctcctccagatcaagagccttggcttcaatgcgataaggcttcccttctgtacccagtcagtaaaaccggggacgatgccaacggcgattgactacgccaagaacccagacctccagggtcttgacagcgtccagataatggagaaaataatcaagaaggctggagacctgggcatattcgtgctcctcgactaccacagaataggatgcaacttcatagagcccctatggtacaccgacagcttctcggagcaggactacataaacacctgggttgaagtcgcccagaggttcggcaagtacttgaacgttatcggcgcggacctgaagaacgaaccccacagctcaagccccgcacctgccgcctacactgacggaagtggggccacgtggggaatgggcaacaacgccaccgactggaacctggcggctgagaggataggaagggcaatcctggaggttgccccacactggcttatattcgtcgagggaacccagttcaccacccccgagatagacggtagctacaagtggggccacaacgcctggtggggcggaaacctcatgggtgttaggaagtacccagtcaacctgcccaggaacaagctcgtctacagcccccacgtttacggtccagacgtttacgaccagccctactttgaccccgctgagggcttccccgacaacctccccgacatatggtaccaccacttcggctacgtaaagcttgatctcggttaccctgttgttataggtgagttcggaggcaagtacggccatgggggagacccgagggatgtcacttggcagaacaagataatagactggatgatccagaacaaattctgtgacttcttctactggagctggaacccaaacagcggtgacaccggtggaattctgaaggatgactggacgacaatatgggaggacaagtacaacaacctgaagaggctcatggacagctgttctggaaacgccactgccccgtccgtccccacgacaactacaacaacaagcacaccgccaacgaccacaacgactacaacatccactccaacgaccactacccagaccccgaccaccactactccaactacgacaaccaccacgaccacaactccttcaaataacgtcccatttgaaattgtgaacgttctcccgactagctcccagtacgagggaaccagcgtggaggttgtatgtgatggaacccagtgtgcctccagcgtttggggagctccgaacctctggggagtcgttaaaatcggaaacgccaccatggaccccaacgtttggggctgggaggacgtttacaagactgcaccccaggacattggaaccggcagcacaaagatggagataaggaacggggtgctcaaggttacaaacctctggaacatcaacatgcatccgaagtataacacaatggcatacccggaggtcatatacggcgccaagccttggggcaaccagccaataaacgctccgaacttcgtgctcccgataaaggtctcccagcttccgaggatactcgttgacacaaagtacacgctcgaaaagagcttcccgggaaacaacttcgcctttgaggcctggctcttcaaggatgccaacaacatgagggcaccaggccagggggactacgagataatggtacagctctacatcgagggcggctatcctgcgggctacgacaaggggccagttctcaccgttgatgttccgataatcgtcgatggaaggcttgtaaaccagacttttgagctctacgacgtcatagcggatgccggatggaggttcttcaccttcaagccaactaagaactacaacggctcagaggttgtgttcgactatcagagctgtcccgcagaaggtattcaacgctcaaggagatgctggagagaactcaatgaccccttccttcttcaaaaactcctctatctcaaggacgtcttcgggagacagctgaaagacccttctctctga

SEQ ID NO: 372 - protein, 754 aa, Unknown
  DOMAIN (1)...(754): Thermococcus AEPII1a protein
  SIGNAL (1)...(29)
  DOMAIN (54)...(390): Cellulase (glycosyl hydrolase family 5)
  DOMAIN (589)...(736): Glycosyl hydrolase family 12
  SITE (200)...(209): Glycosyl hydrolases family 5 signature. Prosite id = PS00659
  SITE (231)...(234): N-glycosylation site. Prosite id = PS00001
  SITE (424)...(427): N-glycosylation site. Prosite id = PS00001
  SITE (524)...(527): N-glycosylation site. Prosite id = PS00001
  SITE (687)...(690): N-glycosylation site. Prosite id = PS00001
  SITE (713)...(716): N-glycosylation site. Prosite id = PS00001
MSSKQKTVAIFVLFVALAGVAGSIPASYAAPSTSTYTTPTGIYYEVRGDTIYMINVATGEETPIHLFGVNWFGFETPNYVVHGLWSRNWEDMLLQIKSLGFNAIRLPFCTQSVKPGTMPTAIDYAKNPDLQGLDSVQIMEKIIKKAGDLGIFVLLDYHRIGCNFIEPLWYTDSFSEQDYINTWVEVAQRFGKYLNVIGADLKNEPHSSSPAPAAYTDGSGATWGMGNNATDWNLAAERIGRAILEVAPHWLIFVEGTQFTTPEIDGSYKWGHNAWWGGNLMGVRKYPVNLPRNKLVYSPHVYGPDVYDQPYFDPAEGFPDNLPDIWYHHFGYVKLDLGYPVVIGEFGGKYGHGGDPRDVTWQNKIIDWMIQNKFCDFFYWSWNPNSGDTGGILKDDWTTIWEDKYNNLKRLMDSCSGNATAPSVPTTTTTTSTPPTTTTTTTSTPTTTTQTPTTTTPTTTTTTTTTPSNNVPFEIVNVLPTSSQYEGTSVEVVCDGTQCASSVWGAPNLWGVVKIGNATMDPNVWGWEDVYKTAPQDIGTGSTKMEIRNGVLKVTNLWNINMHPKYNTMAYPEVIYGAKPWGNQPINAPNFVLPIKVSQLPRILVDTKYTLEKSFPGNNFAFEAWLFKDANNMRAPGQGDYEIMVQLYIEGGYPAGYDKGPVLTVDVPIIVDGRLVNQTFELYDVIADAGWRFFTFKPTKNYNGSEVVFDYQSCPAEGIQRSRRCWRELNDPFLLQKLLYLKDVFGRQLKDPSL

SEQ ID NO: 373 - DNA, 2007 bp, Unknown
  Obtained from environmental sample
atgaattgcactttgaaaccgatggcccgcgtggtcgccggctgcgtcgccacgcttgccctggccgcttgcggcagcgataccggcagcgagggctacacgcagcccgtgttcggcgccactacctacacccagctcaaggtcgacggttataccttcaaggatatgaaccgcaacggcaagatcgacccgtacgaagactggcgcctgtcggccgaggagcgcgccgacgacctgctgtcgcgcctgagcctcgatgaaaaagcgggcctgatgatgcacggcacggcgcccaccgtgtccgacccttccggcatcggcctgggcggcgcgtatgacctggcggccttgcaagacctgatcgtgaagcagtatgtcaacacgtttattacgcgcatggcgggcgatacggccaatatggcggcccagtacaacaaggtgcaggccctgagcgaaacctcgcgccatggcattcccgtctccatcagcacggacccgcgccaccatttccagtatacggtgggcgccagcgcggctacctccggcttctcgcagtggccggaaacactgggcctggccgccattggcgatgatgccctggtgcgccgcttcggcgacatcgcgcgccaggaatacctggccgtcggcatcacgcaagccctgtcgccgcaggcggacctggctaccgagccgcgctggtcgcgcatcaacggcacttttggcgaagacgccgacctggccaagcgcatggtgcagcactatatcgagggcttccaggacggcaatacgggcttgcatgacggcagcgtggtggctgtcgtcaagcactgggtcggctacggcgccacgaaagagggctttgacggccacaattactatggccgctacatgacctacccgggcaacaacttcgcttaccacgtgaagccgttcgaaggggcgttcacggccaaggcggcttccgtcatgccgacgtacgccctgccagacggcaatatcaccatagccggcatcaccctggaacaagtggcggccggtttcagcaagaccatgttgaccgatctgctgcgcggcaaatatggttttgagggggtgatcctgtccgactggggcatcacgtcagactgcgacgccaactgccgcaacggcacggcgccgggcgtcgcgccttcgttcatcggcttcggcacgccgtggggcatggaagacgccaccaaggccgaacgttacgtgaaggctgtcacggcggggatggaccagtttggcggcgtgacggaagcgccgtacctgacgcaagccgtgcagcggggccagctgacggaagcgcgcatcaacgcctcggcgcggcgtatcctgatccaaaaattcaagcagggccttttcgagcatccatttgtcgatgcggccaaggcagccgccacggtgggcaaggcggaattcgtcgaggcgggcctggacgcccagcgccgttcgctggtcctgctggaaaacaaggacaaggtcttgccgctggcggccagcgtcaagaaggtttacctgtacggcatcgacgcggccgtggccaagcagtatggctacacggtggtggccacgccgcaggaagcggacgtggccctgctgcgggtggcggcgccctatgaaaccctgcacccgaattacatcttcggcagcatgcagcacgaaggccgcctgaactatgccgatggcgacgccgactacgaggcgatcaagaacgcggcgaaattcgcgccgaagacggtggtgacggtgtacctggaccgaccggccattctcggcaacgtgcaggacaaggccagtgccattgtcgccaactttggcgtgagcgacggcgcgctgttcgatgtcctgacgggcaaggccaagccgcaaggcaagctgccgttcgagctgccctcgtcgatggccgaagtgcagatgcagaaatcggacgtgccgtatgacacggcccatccgctgtacaagtttggcgccgggctggcgtactga

SEQ ID NO: 374 - protein, 668 aa, Unknown
  Obtained from environmental sample
  DOMAIN (150)...(381): Glycosyl hydrolase family 3 N terminal domain
  DOMAIN (492)...(668): Glycosyl hydrolase family 3 C terminal domain
  SITE (2)...(5): N-glycosylation site. Prosite id = PS00001
  SITE (240)...(243): N-glycosylation site. Prosite id = PS00001
  SITE (337)...(340): N-glycosylation site. Prosite id = PS00001
  SITE (360)...(377): Glycosyl hydrolases family 3 active site. Prosite id = PS00775
  SITE (387)...(390): N-glycosylation site. Prosite id = PS00001
  SITE (451)...(454): N-glycosylation site. Prosite id = PS00001
MNCTLKPMARVVAGCVATLALAACGSDTGSEGYTQPVFGATTYTQLKVDGYTFKDMNRNGKIDPYEDWRLSAEERADDLLSRLSLDEKAGLMMHGTAPTVSDPSGIGLGGAYDLAALQDLIVKQYVNTFITRMAGDTANMAAQYNKVQALSETSRHGIPVSISTDPRHHFQYTVGASAATSGFSQWPETLGLAAIGDDALVRRFGDIARQEYLAVGITQALSPQADLATEPRWSRINGTFGEDADLAKRMVQHYIEGFQDGNTGLHDGSVVAVVKHWVGYGATKEGFDGHNYYGRYMTYPGNNFAYHVKPFEGAFTAKAASVMPTYALPDGNITIAGITLEQVAAGFSKTMLTDLLRGKYGFEGVILSDWGITSDCDANCRNGTAPGVAPSFIGFGTPWGMEDATKAERYVKAVTAGMDQFGGVTEAPYLTQAVQRGQLTEARINASARRILIQKFKQGLFEHPFVDAAKAAATVGKAEFVEAGLDAQRRSLVLLENKDKVLPLAASVKKVYLYGIDAAVAKQYGYTVVATPQEADVALLRVAAPYETLHPNYIFGSMQHEGRLNYADGDADYEAIKNAAKFAPKTVVTVYLDRPAILGNVQDKASAIVANFGVSDGALFDVLTGKAKPQGKLPFELPSSMAEVQMQKSDVPYDTAHPLYKFGAGLAY

SEQ ID NO: 375 - DNA, 2244 bp, Unknown
  Obtained from environmental sample
atgtcgttattcagaccacaccctctgaaaaccgctctggcaactgttctgctcggagccctcaccggacaagcattggccgcccccgcaccgggcgttgatgctttgacgttgaaacagaaaattggccagttgcagcaaatgcacagtgaggccaaaaccgttggagaaatccccgaggaactcaaagccgccatccgcaatggccaagtgggttctatcctgaacatcggcagccccgaggtcgccaacgaactgcagcgcatcgccatgacggaaagcgccgccaagatcccgctgattttcgcccgggatgtaatccacggttatcgcaccatcatgcctactcccttggggcaggcggcgagctggaatgcggacttggtggagaaaggcgctcgcgctgcggcggtggaagcgtccagcgtgggtatccgctggaccttcgcgccgatgatcgacatctcccgcgactcccgctggggccgcattaccgaatcttttggcgaagacccttacctcacctccgttctgaccgtcgcatccgtgcgcggttatcagggcgattctctgagcgatcccactagtattgccgccaccgccaaacattttgtcggctacggcgcggccgagggcgggcgggactacaacgtcacttacatccccgagccgctgctgcacaacatctatctgccgccattcaaagccgccgtggatgcaggggttgcgaccatcatgtccgcattcaatgaactcaacggtgtgcctgcgtctgcccacgattacgcaatcaatacggtattgcgtggcgaatttggtttcgacggcgtgatcgtcagcgactgggattcggtgctggaactgattgctcacggttacgcagcggataaacaacaagccgcattgcaggctttgaaggctggcctcgacattgaaatggtctccaccaccatgcaagagaacttgccagcgctgctcgacagcggcaaggtgagcgaggaggaagtggatgtaaaagtgacccggatcattgacttaaaacgcaatcttggtttgttcgagaagccctatatccaaggtgatccttcgaagtcaatactcactccagagcacaagagcttgagcgaacagctggccctcgaaagtcttgtgctgctgaaaaatgacaagcagaccctgccgttggcgaagggaaagcgcgtcgctttgattggcccgctcgcccacgccgcgcatgaccagttgggttcatgggtgctggatgcgcagaagcaggattcggtgaccgtgctggatgccttccgcaatgtgcttagccaggacaagttgttctactctcaggcgctttacagcagccggtcccgcgacagcaaagatttcgcccaagccatcgagcaggcgaataaggctgacgtgattgtttatgtgggcggtgaagaagcggtgttgagcggcgaggcgcacagtcgtgcggatacccgtctgccgggtgcacaggaacaattgatccgcgaactgaagaagaccggcaagccattggtggtggtgattatggcgggccggccgattgcgatgaatgacgttatcgacgaaattgatgcgctggtgatggcatggcatccgggcaccatgggcggcccggcgattgtccgtttgctgcaaggggatgcggagcccgtgggccgtctgccggtcacttggccgaaagtcaccggccagatgccgatctattacaaccatccgagttctggtcgcccggcgtccgaaggcaacttcacccagatggatgattttccgctggaggctttccaacactctaccggtcacaaaaatcactacattgatataggttttaaaccgcaatttccgtttggatttggtctgagttattccacggtgacatacagcgatatcaaggtggataaaaaagccatcgcgatcaacggcgaattaaaggtgtccgccaaaatcaccaatagcggcaaacgcccggtgacggaaacggcgcagctttatattcgcgatttagtcgccagcagcgtacgaccggtacgggagttgaagagcttccagcgcgttaccctgaagccgaaagaatccaagcgagttaccttcacgttacgcgagagcgatttggcgttttacaaccagaaattggagcacctggtggagcctggtgaattccatgtttggattgcgcctaatgcggaagagggcgtaaaagcggaatttgctgtgcgttga

SEQ ID NO: 376 - protein, 747 aa, Unknown
  Obtained from environmental sample
  SIGNAL (1)...(27)
  DOMAIN (95)...(314): Glycosyl hydrolase family 3 N terminal domain
  DOMAIN (383)...(632): Glycosyl hydrolase family 3 C terminal domain
  SITE (220)...(223): N-glycosylation site. Prosite id = PS00001
  SITE (271)...(288): Glycosyl hydrolases family 3 active site. Prosite id = PS00775
  SITE (600)...(603): N-glycosylation site. Prosite id = PS00001
MSLFRPHPLKTALATVLLGALTGQALAAPAPGVDALTLKQKIGQLQQMHSEAKTVGEIPEELKAAIRNGQVGSILNIGSPEVANELQRIAMTESAAKIPLIFARDVIHGYRTIMPTPLGQAASWNADLVEKGARAAAVEASSVGIRWTFAPMIDISRDSRWGRITESFGEDPYLTSVLTVASVRGYQGDSLSDPTSIAATAKHFVGYGAAEGGRDYNVTYIPEPLLHNIYLPPFKAAVDAGVATIMSAFNELNGVPASAHDYAINTVLRGEFGFDGVIVSDWDSVLELIAHGYAADKQQAALQALKAGLDIEMVSTTMQENLPALLDSGKVSEEEVDVKVTRIIDLKRNLGLFEKPYIQGDPSKSILTPEHKSLSEQLALESLVLLKNDKQTLPLAKGKRVALIGPLAHAAHDQLGSWVLDAQKQDSVTVLDAFRNVLSQDKLFYSQALYSSRSRDSKDFAQAIEQANKADVIVYVGGEEAVLSGEAHSRADTRLPGAQEQLIRELKKTGKPLVVVIMAGRPIAMNDVIDEIDALVMAWHPGTMGGPAIVRLLQGDAEPVGRLPVTWPKVTGQMPIYYNHPSSGRPASEGNFTQMDDFPLEAFQHSTGHKNHYIDIGFKPQFPFGFGLSYSTVTYSDIKVDKKAIAINGELKVSAKITNSGKRPVTETAQLYIRDLVASSVRPVRELKSFQRVTLKPKESKRVTFTLRESDLAFYNQKLEHLVEPGEFHVWIAPNAEEGVKAEFAVR

SEQ ID NO: 377 - DNA, 2250 bp, Unknown
  Obtained from environmental sample
atgacggtggaagaaaaagtcaatatggtcgtcggtgggggcatgttcgtgccgggcatgcagatgccgggtgccgcggcccaggcctccgatgcccagaagagggttttaggcgcggcgggaaccagttttgccatcccgcgcctgggcattcccgggatcgtggtatgcgacggacccgcgggcatacacgcgttcaacgcggggaagagcagggtatactatgccaccgcatggccgatcggtactttgctggcctcgagctgggacaccgccctggtgcggaaagtaggtgcagtctatggcgccgaagcaaaagaatacggaatcgatgtcatcctcggtcccggcatgaatatccaccgcaacccacttggcgcgcggaactttgaatactattctgaagacccggtgcttaccgggattatcgcagctgccatggtcaacgggattcagtcgaacggcgttggcacttcccccaaacatttctttgccaacaaccaggagaccaaccgcaacaccgtaaacacgatcatgagcgaaagggccatgcgtgaaatttatctccggggctggcagctcatgctgaagcattccagtccatggacgatcatgagttcctataacctcgtgaacggaccgtacacctctgaaaatcccgaactgctcaacaccatcctgcgcaaggaatggggcttccagggttttgtcatgaccgactggttcggtggtaaggatgccgtagcccagcaaaaagcaggcaacgacctgctcatgcccggaacgccgcaacaaaagaaagccgtcatggacgccctgaaaagtgggcagctggacgagcaagtgctggaccagaacgttgctgccatcctgaatatcgtcctgaaatctccgaactacgccaattacaaatatagcgataaccctcccctgaaggacaatgcgcagatttccaggcaggcggccgcggagagcatggtcttgttgaagaatgaaggcaaggcgctgccgatcgcgccgggcatgagcctggcggtattcggaaacagcgccgtggaactggttgcgggcggcaccggaagtggtgacgtcaacaagatgtactccgttcccctgtttgacggcctttttaaagcgggctttgcgctgaatacggacctgtaccgggcatatacccaatactatgcggccgaacaggcaaagcgtccgaagcgaaacgccttcgaggacatgtttgcccccaaggcgccgatcgcggaaatgagcatcaccccggaagagatccgcaaggcggcaacgcattcgtccatcgccatcgtggctattggtcgcaatgcgggcgaaggcaaagacagggtactgaaagatgattacttcctgacggaacaggaattggccctcgtgaaaaatgtgtcggcagccttccacgcgcagaacaagaaagtggtggtggtattgaatatcggcggtgtcatcgatgtatctgcatggcgcgacgcggtggatgccatcctgctgggctggcagccgggtctcgaaggcggcaatgcctttgccgacctgatctccggcaaggtaaacccatcgggcaaactggctacaaccttccccctccggtatgaagatgatatcacgtcgaaaaatttccccggccgggaaatccccgggaccgagaagcccggcatgatgggcatgaaaaccgttgatgccgaagtcgtgtatgaagaaggtgtatatgtgggctatcgttattatagcacattcggtgtgcagactgcctatccctttggttatggcctctcctatacccagttcagctttggaaacctgaacattggtgtgccggatgccgatggcaatgtacaggtaagcgttaccgttactaataccggaacggtagcaggcagggaagtggcgcagctatatgtcagcgcgcctgccgggaaaatcgacaagcctgtgctggagctgaaggcatttgacaaaacgaaactgctgcagccgggagaatcccaggagctccgtttcacacttgcacccgcagacctggcatccttccataccgcgcagagcgcatggatcgcggaagccggagcatacacggtgaaattcggcaacgcgcagcaggctgtactgtccggcagtttcaagctccccaaacagctgatcgtggaaaaagtgaacaaggtgattgtgccgaaagtggcgatcaatgaactgaaacctcccgcggggaaatcgaagaaataa

SEQ ID NO: 378 - protein, 749 aa, Unknown
  Obtained from environmental sample
  DOMAIN (43)...(260): Glycosyl hydrolase family 3 N terminal domain
  DOMAIN (326)...(604): Glycosyl hydrolase family 3 C terminal domain
  SITE (229)...(246): Glycosyl hydrolases family 3 active site. Prosite id = PS00775
  SITE (361)...(367): Tubulin subunits alpha, beta, and gamma signature. Prosite id = PS00227
  SITE (477)...(480): N-glycosylation site. Prosite id = PS00001
MTVEEKVNMVVGGGMFVPGMQMPGAAAQASDAQKRVLGAAGTSFAIPRLGIPGIVVCDGPAGIHAFNAGKSRVYYATAWPIGTLLASSWDTALVRKVGAVYGAEAKEYGIDVILGPGMNIHRNPLGARNFEYYSEDPVLTGIIAAAMVNGIQSNGVGTSPKHFFANNQETNRNTVNTIMSERAMREIYLRGWQLMLKHSSPWTIMSSYNLVNGPYTSENPELLNTILRKEWGFQGFVMTDWFGGKDAVAQQKAGNDLLMPGTPQQKKAVMDALKSGQLDEQVLDQNVAAILNIVLKSPNYANYKYSDNPPLKDNAQISRQAAAESMVLLKNEGKALPIAPGMSLAVFGNSAVELVAGGTGSGDVNKMYSVPLFDGLFKAGFALNTDLYRAYTQYYAAEQAKRPKRNAFEDMFAPKAPIAEMSITPEEIRKAATHSSIAIVAIGRNAGEGKDRVLKDDYFLTEQELALVKNVSAAFHAQNKKVVVVLNIGGVIDVSAWRDAVDAILLGWQPGLEGGNAFADLISGKVNPSGKLATTFPLRYEDDITSKNFPGREIPGTEKPGMMGMKTVDAEVVYEEGVYVGYRYYSTFGVQTAYPFGYGLSYTQFSFGNLNIGVPDADGNVQVSVTVTNTGTVAGREVAQLYVSAPAGKIDKPVLELKAFDKTKLLQPGESQELRFTLAPADLASFHTAQSAWIAEAGAYTVKFGNAQQAVLSGSFKLPKQLIVEKVNKVIVPKVAINELKPPAGKSKK

SEQ ID NO: 379 - DNA, 2367 bp, Unknown
  Obtained from environmental sample
atgaaaaaagcatttatgattttaggcgcagcacttgtcaccttgggtgcaagcgcacaacccaaactcaccaaggacaacattgatgaagtgctcaaggctatgaccctcgaggagaaggccgagatcgtagtaggaggaggctggggcagtatgattgccgcttccgttcccacaggttccgcatccctcgtctctggcgccgcaggtaccaccaatcccattgcccgtctcggcatccctgcgaccgtcctcgctgacggccctgccggactgcgcatcaatcctacccgtcccgatacagaccagacattctactgcaccggtttccccgtaggtactgtccttgcttgttcctggaacaccgctctcgtggaggaactcaccacggcaatgggcaacgaagtgctcgaatatggcgctgacgtgctcctcgctcctggtatgaacatccaccgcaaccctctctgcggccgtaacttcgagtatttctcagaggatcctatcctctccggcaagatgggtgctgcatatatcaagggtattcagagcaatggtgtcggtgtatctgcgaagcatttcgcattcaacaaccaggaaatcaaccgtagcgacaatatggccaatgtctctaagagagcagctcgcgagatttatctcaagaactttgagattgctgtccgcgaggcccagccttggaccattatgtcatcctacaatcaggtgaatggcgactacacccagcagagccacgaccttctcaccagcatcctccgcgaggactggggttatgaaggcatcgtgatgaccgactggggtaccaaggacggcacagtcaaggctgtttacgcaggcaatgacctgatggagccgggtgcagacatcgagaagagccgcatcatcgcagctgtcaaggacggcagcctcgatgtcgcagacctcgaccgcaatgtccgcagaatgctcgagtacatcgtcaagactcctcgcttcaagggttacaaattctccaacaagcctgacctcaacgctcacgccgcactcgtgcgcaagggcgcagctgaaggtatggtactcctcaagaacgaagacgctctccctctggccaaggatatcaagaacgtggccctgttcggtctcaacgcctataagtccatcgctggtggtacaggctcaggcaatgtcaacaagccttacatccgcaacgtcgatgagggtctggcagccgcaggtctcaaggttgatgagaaactcgccaagttctacaaggactacagaacttacaatgagagtcttaacgacatcaatggaagcggtggcgattcattcggcatcctcctcggagaggccgttctcgcagaggtcggcatcgccaagagcgcagtcgaggcttctgagaagcgcaacgatgcagctatcgtcgtcatcggccgcaatgctggtgaaggtgatgaccgtagggttcccaatgatttcgagctcacctctgaggagcgtgaacttctcgccaatgtcgagaacgtttaccacaaggctggcaagaaagtcgtcgtggtcctcaatatcggcggtgtcatcgagactgcatcctggaagagccttcccgatgccattctcctcgcttggactcccggacaggaagtcggtaacagcgtggcagatgtgctcgtaggcaagtccaatccttctggaaagctcgctatgacattccctatgaggtatcttgatcatccttcatcattcaatttcccttacaacggacagcccgcaaagggcaatgcaggtgctattgatattgccgcccttatgggactcagcgtcaagcctcagcccgtcaaggatattgactatacagactacaatgaaggtatctgggtgggatatcgttactttgacacagcaggcaaggaagtctcctatcctttcggttatggcctttcatataccacattcgcttatagcgcacccgtggtcaaggctaccaaggacggtggcatcacagccagcatcactgtcaagaataccggttctgtcgcaggtaaggaagctgttcagctctatgtctctgcacctgcaggcggtctcgtgaagcctgccaaggagctcaaggcattcgccaagacacgcgaactccagcctggtgagagccaaaccctcactatggaagtatgcgcctacactctcgcctccttcaatgaagatgcttcacagtgggagactcctgccggcacatacaccgtgaagttcggtgcttccgtagcagacatccgcgcttctgtacccgttcagctcaagaaagctcagagctggaaggtcaacgatgtcctcgctcccgtcaaggaaatcgctgaaatctcagtgaaataa

SEQ ID NO: 380 - protein, 788 aa, Unknown
  Obtained from environmental sample
  SIGNAL (1)...(19)
  DOMAIN (72)...(291): Glycosyl hydrolase family 3 N terminal domain
  DOMAIN (357)...(650): Glycosyl hydrolase family 3 C terminal domain
  SITE (205)...(208): N-glycosylation site. Prosite id = PS00001
  SITE (212)...(215): N-glycosylation site. Prosite id = PS00001
  SITE (435)...(438): N-glycosylation site. Prosite id = PS00001
  SITE (442)...(445): N-glycosylation site. Prosite id = PS00001
MKKAFMILGAALVTLGASAQPKLTKDNIDEVLKAMTLEEKAEIVVGGGWGSMIAASVPTGSASLVSGAAGTTNPIARLGIPATVLADGPAGLRINPTRPDTDQTFYCTGFPVGTVLACSWNTALVEELTTAMGNEVLEYGADVLLAPGMNIHRNPLCGRNFEYFSEDPILSGKMGAAYIKGIQSNGVGVSAKHFAFNNQEINRSDNMANVSKRAAREIYLKNFEIAVREAQPWTIMSSYNQVNGDYTQQSHDLLTSILREDWGYEGIVMTDWGTKDGTVKAVYAGNDLMEPGADIEKSRIIAAVKDGSLDVADLDRNVRRMLEYIVKTPRFKGYKFSNKPDLNAHAALVRKGAAEGMVLLKNEDALPLAKDIKNVALFGLNAYKSIAGGTGSGNVNKPYIRNVDEGLAAAGLKVDEKLAKFYKDYRTYNESLNDINGSGGDSFGILLGEAVLAEVGIAKSAVEASEKRNDAAIVVIGRNAGEGDDRRVPNDFELTSEERELLANVENVYHKAGKKVVVVLNIGGVIETASWKSLPDAILLAWTPGQEVGNSVADVLVGKSNPSGKLAMTFPMRYLDHPSSFNFPYNGQPAKGNAGAIDIAALMGLSVKPQPVKDIDYTDYNEGIWVGYRYFDTAGKEVSYPFGYGLSYTTFAYSAPVVKATKDGGITASITVKNTGSVAGKEAVQLYVSAPAGGLVKPAKELKAFAKTRELQPGESQTLTMEVCAYTLASFNEDASQWETPAGTYTVKFGASVADIRASVPVQLKKAQSWKVNDVLAPVKEIAEISVK

SEQ ID NO: 381 - DNA, 2172 bp, Unknown
  Obtained from environmental sample
atgcggcccgatcccaagatggaccagttcatcagcgacttgatcgcgaagatgacgctggacgagaagatcggccagctcaccctgttgacgaccgactgggagtcgaccgggccgacgctgcgtgccggctataaggaagatgtcgccgcggggcgcgtgggcgcgatgttcaatgcgcattcggtgaagttcacgcgtgagcttcagcgcatggcggtggaggagacgcggctcaagattccgctgctgttcggctatgacgtgatccacggccaccgcacgatgttcccgatctcgctcggcgaggcggcttcatgggaccttgcggcgatcgagaaggccgcgcgcatttcggcgatcgaaggcgcggccgaggggctgcactggacctttgcgccgatggtcgacattgcgcgcgatccgcgctggggccgcatgtccgaaggcgcgggcgaggacgtctatctcggcagccgcatcgccgaggcacgcgtgcgcggctatcagggcaagcgcatcggcgataccgacagcctgatcgccaccgtcaagcatttcgccgcctatggcgcggcgcaggccggccgtgactatcacaccaccgacatgtcggatcgcgagctgcgagacacccacctgcccccgttcaaggctgccatcgacgctggcgcggcgacggtgatgacctcgttcaacgagctcaacggcattccggcgagcggcaacagctatctgctgaccgacatcctgcgcaaggaatggggcttcaagggctttgtcgtaaccgattacacgtcgatcaacgaaatggtcccgcacggctattccaaggacgaggctcaggccggcgaacaggcgatcaatgccggggtcgacatggacatgcagggcgcggtgttcatgaaccacctcgccaaatcggttgccgaagggcgggtgccgatggcgcggatcgacgccgccgtgcgctcggtgctcgagatgaagtaccggctcggcctgttcgccgacccctatcgcttcagcgacgccgcgcgcgaaaaggcgcgtgtcggcaccgccgagcacaaggccgccgcgcgcgacgtggcgcgcaagtcgatggtgctgctcaagaacgacggttcgcttccgctcgtcgcatcggcgcgcaaaatcgcggtgatcggcccgctcgccgacagcaagcccgacatgatcggcagttgggcggcgcagggcgatcgccagggatcggtcaccgtgctcgaggggatccgcgcgcgcgccaagggcgcgacggtcagctatgccaagggcgccagctaccagttcgaggatgccggcaagaccgacggctttgccgaggcgctggccgccgcgcgcgacgccgatgtcatcgttgcggcgatgggcgagcattacgaccataccggcgaagcggctagccgcacctcgctcgacctgccgggcaatcagcaggcgctgctcgaagcgctcaaggcgacgggcaagccggtggtgctcgtgctgctttccggccgccccaattcaatcggctgggccgcggaaaacgtgaactccatcctgcatgcctggtatcccggcacgatgggcggccatgccgtggcggacgtgctgttcggcgactacaacccctcgggcaagctgccggtcaccttcccgcgcaatgtcggccaggtgccgatctattacagcatgaagaacaccggccggccctatacggccgacaaacaggggcagaaatatctctcgcgctacctcgattcgcccaacagcccgctttatccgttcggctatgggctgagctacacgagcttcggctactcgccggtcaccctcgacaagacgcgcatccgccccggcgaaacgctgaccgccacggttacggtcaccaacaccggcaagcgcgcaggtgaggaggtcgtccagctctatgtccgcgacctggtcggttcggtgacgcgcccggtcaaggagctcaaggggttccgcaaggtgatgctcaagccgggtgaggcgcgccggatctcgttcagcctgacggaccgcgaccttgcattccaccgtgccgacatgagctatggcgcggagccgggcgagttccggctgtggatcgggccgtcctcggccgaaggcagcgagaccggcttcacgctgaccgaatag

SEQ ID NO: 382 - protein, 723 aa, Unknown
  Obtained from environmental sample
  DOMAIN (73)...(297): Glycosyl hydrolase family 3 N terminal domain
  DOMAIN (369)...(607): Glycosyl hydrolase family 3 C terminal domain
MRPDPKMDQFISDLIAKMTLDEKIGQLTLLTTDWESTGPTLRAGYKEDVAAGRVGAMFNAHSVKFTRELQRMAVEETRLKIPLLFGYDVIHGHRTMFPISLGEAASWDLAAIEKAARISAIEGAAEGLHWTFAPMVDIARDPRWGRMSEGAGEDVYLGSRIAEARVRGYQGKRIGDTDSLIATVKHFAAYGAAQAGRDYHTTDMSDRELRDTHLPPFKAAIDAGAATVMTSFNELNGIPASGNSYLLTDILRKEWGFKGFVVTDYTSINEMVPHGYSKDEAQAGEQAINAGVDMDMQGAVFMNHLAKSVAEGRVPMARIDAAVRSVLEMKYRLGLFADPYRFSDAAREKARVGTAEHKAAARDVARKSMVLLKNDGSLPLVASARKIAVIGPLADSKPDMIGSWAAQGDRQGSVTVLEGIRARAKGATVSYAKGASYQFEDAGKTDGFAEALAAARDADVIVAAMGEHYDHTGEAASRTSLDLPGNQQALLEALKATGKPVVLVLLSGRPNSIGWAAENVNSILHAWYPGTMGGHAVADVLFGDYNPSGKLPVTFPRNVGQVPIYYSMKNTGRPYTADKQGQKYLSRYLDSPNSPLYPFGYGLSYTSFGYSPVTLDKTRIRPGETLTATVTVTNTGKRAGEEVVQLYVRDLVGSVTRPVKELKGFRKVMLKPGEARRISFSLTDRDLAFHRADMSYGAEPGEFRLWIGPSSAEGSETGFTLTE

SEQ ID NO: 383 - DNA, 1404 bp, Unknown
  Obtained from environmental sample
atgaatcattctctttcatttccgccatcctttgtatggggcgcagcaaccgcaagctaccaactggaaggatcaacccagggcgtggacggctgcgccgagtccgtctgggatatgcactgccgcagatccggcgcgatcaaggacggctcgaacggattcgtcgcctgcgatcactaccaccgctatcgcgaggatgtggcgctcatgaacgagcttggcttgaatgcctatcgattctcaatcatgtggccccgcgtcatgcccgaaggcaccggcgcggtgaacgagaagggcatggacttctacaatcggttggttgatgaactgctcgccgccggcatcactccttgggttactttgttccactgggactttcccctagccttgttccaacgcggtggctggctgaatgcggattccccgcaatggtttgaggattacacccgggaagtggttaaacgcttgtcggatcgcgtgcatcactggctgacgctcaacgaaccggcctgcttcattgagtttggccaccgtaccggcatgcatgcacccggcttgcaactggcggacaaggaagcctgccgggtctggcaccatgccatgctggcccacggtcgcgccgttcgcgctatccgcgaggaatccgtgcatccatcaccccaggttggctacgccccggtcttccgtaccaccatcccggacactgaagatcctgccgacatcgaagcggcccgggcctcgatgtttgcccatcaggccggcaacctgttcgatacgcggtggaacctcgccccctgctttcggggcgcgtatccggagatcatgatgcagtattggggcgatgccgcgccgcgcatccaggacggcgacatggagttgatccgtcaggaactcgattttctcggcttgaatatttaccagtccgagcgcattcgagccggtgcggatggcgcacccgaggtggtgccataccctgcggattatccgcgcaaccagctcggttggcccatcacgccggaggccctgcgctgggcgaccctctttctctttgaggagtacgggaaacccctgatcatcacagaaaacggaatcaccctcgacgacaagcccaatgcagacggcgaggtgaatgatgtccagcggatcgcttttttgaacgactatcttagcggtctccagcgcagcgtggacgacggcatccctgtactgggctatttccactggtcgctgtgcgacaactttgagtgggcagaaggctatgtccctcgcttcggcctgatccatgtggactatgccagtcaacgcagaaccatcaaggcctcaggacggttttaccgcgacatcattcggggccagacagccacgccctgcatcgcccaatccagtcagccggaaacaacctaa

SEQ ID NO: 384 - protein, 467 aa, Unknown
  Obtained from environmental sample
  DOMAIN (3)...(454): Glycosyl hydrolase family 1
  SITE (2)...(5): N-glycosylation site. Prosite id = PS00001
  SITE (11)...(25): Glycosyl hydrolases family 1 N-terminal signature. Prosite id = PS00653
MNHSLSFPPSFVWGAATASYQLEGSTQGVDGCAESVWDMHCRRSGAIKDGSNGFVACDHYHRYREDVALMNELGLNAYRFSIMWPRVMPEGTGAVNEKGMDFYNRLVDELLAAGITPWVTLFHWDFPLALFQRGGWLNADSPQWFEDYTREVVKRLSDRVHHWLTLNEPACFIEFGHRTGMHAPGLQLADKEACRVWHHAMLAHGRAVRAIREESVHPSPQVGYAPVFRTTIPDTEDPADIEAARASMFAHQAGNLFDTRWNLAPCFRGAYPEIMMQYWGDAAPRIQDGDMELIRQELDFLGLNIYQSERIRAGADGAPEVVPYPADYPRNQLGWPITPEALRWATLFLFEEYGKPLIITENGITLDDKPNADGEVNDVQRIAFLNDYLSGLQRSVDDGIPVLGYFHWSLCDNFEWAEGYVPRFGLIHVDYASQRRTIKASGRFYRDIIRGQTATPCIAQSSQPETT

SEQ ID NO: 385 - DNA, 2457 bp, Unknown
  Obtained from environmental sample
atgtcagagacaattgaccggttgctggcggagatgacgctggaggaaaagatcaagctgctgggcggttggcgcgcggtaccaggtacgccgcgggacgcagacgtatatggcgtaccccgtctagggatagccccactcagattggcggacggtccgaccggggtccattggtggaccaaggcatcgacctgttacccggccctgattaatttggcggcttcttttgatgaaaagattgcctacacattcggacgcgcactgggaaccgattgccgtgctttcggggtacatgtgatcctcgctcccggtgtaaacctgtaccgctctccattatgtggacggaacttcgaatatctcggagaggacccggaattggccggaggactggccgcagcctacatccgtggtttgcaatcaaaaggagtggctgctaccgtcaaacacctggcagccaataatcaggaatacgatcgtcacaatatcagctcggatattgacgagcgcaccttgcgcgaagtctacctacgcccctttgaaagggctgtccatgaagggcaaacggcagcagtcatgacggcatataatccggtcaatggacagcatgcctcggaaaatgcctggctgctggatggcgtgttgcgccacgattggggcttcaacgggtggattatgtcggattggacatccgtctattccacagtgcagactttgaatagcgggttggatctggaaatgccgtttgccttgcacctgacggaagaaaaaatcaaagctgctttggcgaccggggtcacgactgtcacccgcatcgatcgcatggtactgcaccgattggcactgatggagcgcttcgggtggttggatcccgggcatgcacagcaggataagtcattgcccgaccgtaaccccgaaaccgaagccgtggctttggaggtggcacgccgcggcattgtactgcttaagaatcgaaaccatgtcttgccctgtccgcctgccagcctgcgccgcatcgtcgtgctggggcatcacgcagcccaacccattctgtccgggggcggttcagccttctgcccgccgcacgaatcggtaaccctgctggaggcactgcgccagacatacgcgcaggatgtgcaggtggattatttcgagatggtagatccgtggtgcgaacgggctgctttggaagcgagtagcttttatacggctgatggcgaaccgggcttgcatgcctgctactttgccaataatcgcctggaaggctcccctgccctcgagcgggtggataccaaactgcaattccgttggatttctgaaaaaccggatccaatgctggaagatgattatttttcggcacgctggagcggctttttcgatattgatgctgccggtatctacgactggtatctgaaaagcgaagacgggacatttcaggtatgggtggatgatcatcccctgacggatccctttacaggcacgcggcgtgttcctcttgatctgtctgcgggacaacatcggataactgtcacctattgccagttgcgcggcggatgggccacctgccaatgtggctttgaacgcgcagctaatgcgcttcgtgcatatgaggacggtctggctgcagcagccgaagcagatcttgtggtggttacaaccggttttgtggcacccacggaacgggaatccagtgaccgcacatttgaattggatcagcgcctgaatcaaatggtcctcgatgtagccagacagaatgcgcgcacggttgttgttttgtatgcaggtggcgccgtggatgtggcaccgtggatcgatcaggttgcggctttgttgcatatctggtatcccggtcaaaacggtacgctggcagcagccgagataattgccggatacactaacccatcgggcaaattacctttcacatgggaacatcaactctctgaccgcggttcctttagcgcatatcatgatgacgatggggatggccgcgtggcttacacagatggtgtttttaccggatatcgatggttcgaccatcaccggataaaagcacgctatccatttggattcggcttgtcatacactacatttgcctatgaaaatcttgcctgtactcctgctacgttgcaggagaacgaaacggtccaagtaacgttcgacgtgatcaacaccggcagcgtggccggacgacatgctgcgctagtctttgtggctccgcctgcgggtacggttccgagacccgtaaaggaatacaagcaatcgtgcgtggttaatctagcacctggtgaacggcagtccgtcactgtcaccttgccatggcgcgccttccagttttggcatccagatacacgatgctggagcatcaccccgggtgcacatgcaattcaagtccgaccggacgccgatagcacggggctgcaagctgaagtcacactggtggatggacacgccaaacgatga

SEQ ID NO: 386 - protein, 818 aa, Unknown
  Obtained from environmental sample
  DOMAIN (36)...(247): Glycosyl hydrolase family 3 N terminal domain
  DOMAIN (318)...(695): Glycosyl hydrolase family 3 C terminal domain
  DOMAIN (405)...(539): PA14 domain
  SITE (15)...(27): Lipocalin signature. Prosite id = PS00213
  SITE (163)...(166): N-glycosylation site. Prosite id = PS00001
  SITE (627)...(630): N-glycosylation site. Prosite id = PS00001
  SITE (721)...(724): N-glycosylation site. Prosite id = PS00001
MSETIDRLLAEMTLEEKIKLLGGWRAVPGTPRDADVYGVPRLGIAPLRLADGPTGVHWWTKASTCYPALINLAASFDEKIAYTFGRALGTDCRAFGVHVILAPGVNLYRSPLCGRNFEYLGEDPELAGGLAAAYIRGLQSKGVAATVKHLAANNQEYDRHNISSDIDERTLREVYLRPFERAVHEGQTAAVMTAYNPVNGQHASENAWLLDGVLRHDWGFNGWIMSDWTSVYSTVQTLNSGLDLEMPFALHLTEEKIKAALATGVTTVTRIDRMVLHRLALMERFGWLDPGHAQQDKSLPDRNPETEAVALEVARRGIVLLKNRNHVLPCPPASLRRIVVLGHHAAQPILSGGGSAFCPPHESVTLLEALRQTYAQDVQVDYFEMVDPWCERAALEASSFYTADGEPGLHACYFANNRLEGSPALERVDTKLQFRWISEKPDPMLEDDYFSARWSGFFDIDAAGIYDWYLKSEDGTFQVWVDDHPLTDPFTGTRRVPLDLSAGQHRITVTYCQLRGGWATCQCGFERAANALRAYEDGLAAAAEADLVVVTTGFVAPTERESSDRTFELDQRLNQMVLDVARQNARTVVVLYAGGAVDVAPWIDQVAALLHIWYPGQNGTLAAAEIIAGYTNPSGKLPFTWEHQLSDRGSFSAYHDDDGDGRVAYTDGVFTGYRWFDHHRIKARYPFGFGLSYTTFAYENLACTPATLQENETVQVTFDVINTGSVAGRHAALVFVAPPAGTVPRPVKEYKQSCVVNLAPGERQSVTVTLPWRAFQFWHPDTRCWSITPGAHAIQVRPDADSTGLQAEVTLVDGHAKR

SEQ ID NO: 387 - DNA, 1362 bp, Unknown
  misc_feature: Bacterial DNA
atgcttcagtttccgaaagattttatttggggagctgcaacttcatcgtatcaaattgaaggaacagcgactggagaagataaaatttactcgatctgggatcacttttcccgcattcctggcaaaatagcgaatggggataatggcgatattgcaattgatcattacaatcgttatgttgaagacatcgcattaatgaaagcgcttcatttgaaagcgtatcgattttcgactagttgggcgagactttattgtgaaacgccagggaagtttaacgaaaaaggtttagatttttataagcgtcttgtaaatgagctgctagagaacggtatcgagccaatgttgaccatttatcattgggatatgccacaagctcttcaagagaaaggtggctgggaaaatcgtgatatcgttcaatacttccaagaatacgctgctttcctttacgagaatcttggggatgtcgtgaaaaaatggattacgcataatgagccgtgggttgtcacctatttaggatatgggaatggcgaacatgccccagggattcaaaactttacatcatttttaaaagcagcacatcatgttcttctctcacacggggaagcggtaaaagcgtttcgagcaatcggtccgaaagatggggaaattggtattacgttgaatttgacacctggatatgcggttgatccgaaagatgaaaaagcagttgatgccgctcgaaaatgggacggctttatgaatcgttggtttttagatcctgtatttaagggacaatatccagcagatatgttagaagtgtataaagattatttaccagacgtttacaaagagggagatttacaaacgattcagcaaccgatcgactttttcggatttaactattattcaacagcaacattaaaagattggaaaaaaggtgaccgtgaaccgatcgtatttgaacatgtgagcacaggaagacctgtgacggatatgaattgggaagtgaatccaaacggtttgtttgatttaatggtgcgattgaaaaaagattatggcgatattccattatacattaccgaaaacggtgctgcatacaaagatcgcgtcaacgaacaaggtgaagtagaagatgatgagcgagttgcttatatacgagagcatttaatcgcttgccaccgcgcgattgaacaaggcgtcaatttaaaaggatattatgtatggtcgctgttcgataattttgagtgggcatttggatatgataagcgctttgggattgtatacgtggattatgaaacgctagagcgcatcccgaaaaagagtgcattatggtataaggaaacgattataaacaacggattgaaagcagaaaaagataaataa

SEQ ID NO: 388 - protein, 453 aa, Unknown
  DOMAIN (1)...(453): Bacterial protein
  DOMAIN (1)...(447): Glycosyl hydrolase family 1
  SITE (8)...(22): Glycosyl hydrolases family 1 N-terminal signature. Prosite id = PS00653
  SITE (186)...(189): N-glycosylation site. Prosite id = PS00001
  SITE (355)...(363): Glycosyl hydrolases family 1 active site. Prosite id = PS00572
MLQFPKDFIWGAATSSYQIEGTATGEDKIYSIWDHFSRIPGKIANGDNGDIAIDHYNRYVEDIALMKALHLKAYRFSTSWARLYCETPGKFNEKGLDFYKRLVNELLENGIEPMLTIYHWDMPQALQEKGGWENRDIVQYFQEYAAFLYENLGDVVKKWITHNEPWVVTYLGYGNGEHAPGIQNFTSFLKAAHHVLLSHGEAVKAFRAIGPKDGEIGITLNLTPGYAVDPKDEKAVDAARKWDGFMNRWFLDPVFKGQYPADMLEVYKDYLPDVYKEGDLQTIQQPIDFFGFNYYSTATLKDWKKGDREPIVFEHVSTGRPVTDMNWEVNPNGLFDLMVRLKKDYGDIPLYITENGAAYKDRVNEQGEVEDDERVAYIREHLIACHRAIEQGVNLKGYYVWSLFDNFEWAFGYDKRFGIVYVDYETLERIPKKSALWYKETIINNGLKAEKDK

SEQ ID NO: 389 - DNA, 2103 bp, Unknown
  Obtained from environmental sample
atgatacatgccagctcttcgttcacatccgggggtgtggaaaggcttggcatacctgagctcattatgtctgatggtcctcatggtgtgcggcatgaacacgggcgtggctggtttgcactcgaagatgctgacgacatggcgacttatttacccgtaggtatcaaccttgcttcaacatggaacagggaactgggctatgaatacggtgttgtgcttggcaatgaagccaaagaaaggggcaagcatgttctccttggtcctggtgttaatatcattcgcagtcccctgaatggccgtaattttgaatacttaagtgaggatcccttcctgaccgctgaaatggctgtgggatatacccttggagtgcaggatcagggagtggcggtatgtgtaaaacattatgctgccaataaccaggaaaccgaccgtcataatattgatgtaattgttagcaagcgcgctctgcacgaaatttacttccctgcttttaaagctacggtgcaggaagccggtgcatggagcatcatgggggcttacaacaagatcaatgggcaatacaccacccaccacgaatatcttaacaatgaaattctgaaaggaaagtggggttttgatggggttgtgataagtgactgggcatcagtaaaggatacccgcgaagcacttttatatggtaccgaccttgaaatgggcaccgagctgttgggagatttcaccaatcctgattatgatgatttctatctggcacgccacgcaaagaaaatgattgaaagtggcgaaattgatgaaagttatgttgacgaaaaagtgcgccggatccttaaactgatgtaccgtaccactgcccttggtaaacatggacctggtaagcgaaatgtacccgaacaccagcaactggcactgaaggtggcccaggaaggaattgttttgctgaaaaatgatggcctgttgccactcaataaaaaggagatcactacaatagctgtcatcgggcacaatgccacaaggctttttgccgaacggggaggcagctcacaggtaagagccctgtatgagatcactccgctggaaggaataatgaatctcgtgggtaatgatgtggaagtgatctacgccgaaggatatgagccctactatgatgaaacccttttcaggggtgcatcgggagatgctgcttcccagtcaagatccaacagaagaactgttgaactggccagaactgccaacaaggaacttgccagggaagcacttgaagttgcacaaaaagccgacattgtgatctttgtgggaggatggatacatggccacgaaggaatgccctggggtgaaggaacctacgatgccgaagcccgcgataaactcaatatcaaacttccctttggccaggaacaacttatccgcgagataaaccgggcaaacaaacaaacggttgtggtactcatgggtggcagcaacgtggagatggataactggctgccagaaacgccagcataccttcatgcctggtaccccggtatggaagggggcactgccattgcgcaggtacttttcggcgaagtgaatccttcaggaaaactgccaatgacatttgccaattcacacaaggattacccttctcattccatcggcgaatttccaggatacaaaaaagtacattacaccgaggatatttttgtaggataccgccacttcgatgcaaagggtaaagatgtggtgttcccctttgggtttggactttcctatacaaccttcgatttctcagggctgaagctgaccaggcaaggaaataaagtgatcgtggaatgtaaggttaccaatacaggaaaccgggtcggtgccgaggtggtgcaggtttatgtgcatcagaaagagtcttcggtggaacggcccatccgtgaactgaaagggtttgaaaaggtaatgctcaatccgggtgaaacaacaacagtgaagatcggactcgatgcatcatcttttagtttcttccatccggaacgtcttgaatggactttggaaccaggcatgtttgaaattgcagtgggctcatcatccagagatctgccactgaaaggttcaatagatattggtatgcttgaatag

SEQ ID NO: 390 - protein, 700 aa, Unknown
  Obtained from environmental sample
  DOMAIN (10)...(232): Glycosyl hydrolase family 3 N terminal domain
  DOMAIN (309)...(562): Glycosyl hydrolase family 3 C terminal domain
  SITE (201)...(218): Glycosyl hydrolases family 3 active site. Prosite id = PS00775
  SITE (339)...(342): N-glycosylation site. Prosite id = PS00001
MIHASSSFTSGGVERLGIPELIMSDGPHGVRHEHGRGWFALEDADDMATYLPVGINLASTWNRELGYEYGVVLGNEAKERGKHVLLGPGVNIIRSPLNGRNFEYLSEDPFLTAEMAVGYTLGVQDQGVAVCVKHYAANNQETDRHNIDVIVSKRALHEIYFPAFKATVQEAGAWSIMGAYNKINGQYTTHHEYLNNEILKGKWGFDGVVISDWASVKDTREALLYGTDLEMGTELLGDFTNPDYDDFYLARHAKKMIESGEIDESYVDEKVRRILKLMYRTTALGKHGPGKRNVPEHQQLALKVAQEGIVLLKNDGLLPLNKKEITTIAVIGHNATRLFAERGGSSQVRALYEITPLEGIMNLVGNDVEVIYAEGYEPYYDETLFRGASGDAASQSRSNRRTVELARTANKELAREALEVAQKADIVIFVGGWIHGHEGMPWGEGTYDAEARDKLNIKLPFGQEQLIREINRANKQTVVVLMGGSNVEMDNWLPETPAYLHAWYPGMEGGTAIAQVLFGEVNPSGKLPMTFANSHKDYPSHSIGEFPGYKKVHYTEDIFVGYRHFDAKGKDVVFPFGFGLSYTTFDFSGLKLTRQGNKVIVECKVTNTGNRVGAEVVQVYVHQKESSVERPIRELKGFEKVMLNPGETTTVKIGLDASSFSFFHPERLEWTLEPGMFEIAVGSSSRDLPLKGSIDIGMLE

SEQ ID NO: 391 - DNA, 1341 bp, Unknown
  Obtained from an environmental sample
atgaacgtgaaaaagttccctgaaggattcctctggggtgttgcaacagcttcctaccagatcgagggttctcccctcgcagacggagctggtatgtctatctggcacaccttctcccatactcctggaaatgtaaagaacggtgacacgggagatgtggcctgcgaccactacaacagatggaaagaggacattgaaatcatagagaaactcggagtaaaggcttacagattttcaatcagctggccaagaatacttccggaaggaacaggaagggtgaatcagaaaggactggatttttacaacaggatcatagacaccctgctggaaaaaggtatcacaccctttgtgaccatctatcactgggatcttcccttcgctcttcagctgaaaggaggatgggcgaacagagaaatagcggattggttcgcagaatactcaagggttctctttgaaaatttcggtgatcgtgtgaagaactggatcaccttgaacgaaccgtgggttgttgccatagtggggcatctgtacggagtccacgctcctggaatgagagatatttacgtggctttccgagctgttcacaatctcttgagggcacacgccagagcggtgaaagtgttcagggaaaccgtgaaagatggaaagatcggaatagttttcaacaatggatatttcgaacctgcgagtgaaaaagaagaagacatcagagcggtgagattcatgcatcagttcaacaactatcctctctttctcaatccgatctacagaggagattacccggagctcgttctggaatttgccagagagtatctaccggagaattacaaagatgacatgtccgagatacaggaaaagatcgactttgttggattgaactattactccggtcatttggtgaagttcgatccagatgcaccagctaaggtctctttcgttgaaagggatcttccaaaaacagccatgggatgggagatcgttccagaaggaatctactggatcctgaagaaggtgaaagaagaatacaacccaccagaggtttacatcacagagaatggggctgcttttgacgacgtagttagtgaagatggaagagttcacgatcaaaacagaatcgattatttgaaggcccacattggtcaggcatggaaggccatacaggagggagtgccgcttaaaggttacttcgtctggtcgctcctcgacaatttcgaatgggcagagggatattccaagagatttggtattgtgtatgtagactacagcactcaaaaacgcatcgtaaaagacagtgggtactggtactcgaatgtggttaaaaacaacggtctggaagactga

SEQ ID NO: 392 - protein, 446 aa, Unknown
  Obtained from an environmental sample
  DOMAIN (2)...(444): Glycosyl hydrolase family 1
  SITE (10)...(24): Glycosyl hydrolases family 1 N-terminal signature. Prosite id = PS00653
  SITE (352)...(360): Glycosyl hydrolases family 1 active site. Prosite id = PS00572
MNVKKFPEGFLWGVATASYQIEGSPLADGAGMSIWHTFSHTPGNVKNGDTGDVACDHYNRWKEDIEIIEKLGVKAYRFSISWPRILPEGTGRVNQKGLDFYNRIIDTLLEKGITPFVTIYHWDLPFALQLKGGWANREIADWFAEYSRVLFENFGDRVKNWITLNEPWVVAIVGHLYGVHAPGMRDIYVAFRAVHNLLRAHARAVKVFRETVKDGKIGIVFNNGYFEPASEKEEDIRAVRFMHQFNNYPLFLNPIYRGDYPELVLEFAREYLPENYKDDMSEIQEKIDFVGLNYYSGHLVKFDPDAPAKVSFVERDLPKTAMGWEIVPEGIYWILKKVKEEYNPPEVYITENGAAFDDVVSEDGRVHDQNRIDYLKAHIGQAWKAIQEGVPLKGYFVWSLLDNFEWAEGYSKRFGIVYVDYSTQKRIVKDSGYWYSNVVKNNGLED

SEQ ID NO: 393 - DNA, 2229 bp, Unknown
  Obtained from environmental sample
gtggaaagaatcccatttgttgaagatttactggcccaaatgaccctggaagagaaagtggggcaaatggcacagataacccttgatgtgattaccattggggaagataacactgtatctgacgaacccattgcactggacatggacctggtaagatgggcagtggcagaatacggtgtgggttcggtgctcaacaccgccaataacagggcgcgtacccgcgaaaaatggcacaccatcgtcagccagctgcaggatgttgccatcaatgaaacccgcctgggtattcctgttttgtatggtattgatgccattcatggaacaacttacactgccggtgcaaccttttttccacagcaaatcgggcaggccgctacttttaatccttcattggtgcgcaaagcagctgaaattactgcctacgaaacccgtgcctctgccatcccctggactttctctccggtacttgatatggggcgcgatcctcgtttcccaaggatgtgggaaacctttggggaagatgtttatcttgctaccgtgcttggcgtagaaatgatcaaaggatatgaaggggagaataatgacattagtgatcctttcagagtagcatcctgtgcgaagcattacctgggttacagtgtcccggtttcaggaaaagaccggaccccggctctgataccggaaattgaacttcgcgaaagacacctgcccccgtttcaggcagctgtggaagccggtacccacaccattatggtaaactccggccttatcaacggagtgcccgttcatgcctcttatgaactgcttacggaaatgctgaagaaagaacttgggtttacaggattgttgttaaccgactggaccgatattgagaatctgcatacccgcgaccgtattgccgccacatcaaaagaagcagttaagctggccataaatgcaggaattgatatgtccatgattccctacgatctcgacttttgtgattacctgattgaactggtgaatgaaggagaagttcccatgtcgcgtatcgacgatgccgtgagacggattcttaatacaaaatacaagcttggcctttttgaaactcctgttacttatcacagtgattacccgctgtttggaagcgacgaatttattgaagttgcgtaccagacagcacaggaatccataacactgcttaaaaatgaaaacaatgttttgcctttgcgtaaaaacgctcgggtgctggtaaccggacccaattccaactctatgcgatcactcaatggtggctggagctattcatggcagggagagaaagtggatgagtttgctgaagaatattctaccattctagatgccatccgggaaaaagttggtgaaaataacgctgtatttcgcgaaggggttcgatatgataatgaaagccagtactgggtagatgaagcttttgatatacagggagctgtaagagctgcagcgcaggtagattacatcatcattgcattaggagaaaactcttatgctgagaaaccaggcgatttacatgatctttctttgtcacaaaatcagattgagcttgccaaagcccttgccaaaaccggtaagcccatgatactggttttgaaccagggtcgcccgcgtatcatcagggaaatcgaacccctgatgagtggaataatcaatgcttatctgccgggaaactacggcggacctgctgttgcagatgtgatttttggagattataaccccaatgggaaactcccttttacctatccgctttatgtcaattctctggttacctatgatcataaaccctcagaagatcaggcgagaatggagggggtgtatgattatgaatcggattttgccattcaatatgaatttggttttggtttgagttataccacctttgaatattccaacctgaccattagcaatgaaaggttgtctatgaacgggaagctggaagttaccgttgatgtaaaaaataccggtgaactgccaggtcaggaagtggtgcagttatacacttcggcacattatacttcagttacacctgatgtgaaaaggctcagaggtttcagtaagatccacctcgaacccggacaaaagaaatcggtatcctttaccctttctccatctgatatttcttttatcaatgcgcaaaacagaagggtaaatgaacccggtgcctatgatgtgcttatcgaaagtctttcctcaaccttcaggcttgtagaatag

SEQ ID NO: 394 - protein, 742 aa, Unknown
  Obtained from environmental sample
  DOMAIN (88)...(320): Glycosyl hydrolase family 3 N terminal domain
  DOMAIN (391)...(631): Glycosyl hydrolase family 3 C terminal domain
  SITE (65)...(68): N-glycosylation site. Prosite id = PS00001
  SITE (91)...(94): N-glycosylation site. Prosite id = PS00001
  SITE (276)...(293): Glycosyl hydrolases family 3 active site. Prosite id = PS00775
  SITE (475)...(478): N-glycosylation site. Prosite id = PS00001
  SITE (645)...(648): N-glycosylation site. Prosite id = PS00001
MERIPFVEDLLAQMTLEEKVGQMAQITLDVITIGEDNTVSDEPIALDMDLVRWAVAEYGVGSVLNTANNRARTREKWHTIVSQLQDVAINETRLGIPVLYGIDAIHGTTYTAGATFFPQQIGQAATFNPSLVRKAAEITAYETRASAIPWTFSPVLDMGRDPRFPRMWETFGEDVYLATVLGVEMIKGYEGENNDISDPFRVASCAKHYLGYSVPVSGKDRTPALIPEIELRERHLPPFQAAVEAGTHTIMVNSGLINGVPVHASYELLTEMLKKELGFTGLLLTDWTDIENLHTRDRIAATSKEAVKLAINAGIDMSMIPYDLDFCDYLIELVNEGEVPMSRIDDAVRRILNTKYKLGLFETPVTYHSDYPLFGSDEFIEVAYQTAQESITLLKNENNVLPLRKNARVLVTGPNSNSMRSLNGGWSYSWQGEKVDEFAEEYSTILDAIREKVGENNAVFREGVRYDNESQYWVDEAFDIQGAVRAAAQVDYIIIALGENSYAEKPGDLHDLSLSQNQIELAKALAKTGKPMILVLNQGRPRIIREIEPLMSGIINAYLPGNYGGPAVADVIFGDYNPNGKLPFTYPLYVNSLVTYDHKPSEDQARMEGVYDYESDFAIQYEFGFGLSYTTFEYSNLTISNERLSMNGKLEVTVDVKNTGELPGQEVVQLYTSAHYTSVTPDVKRLRGFSKIHLEPGQKKSVSFTLSPSDISFINAQNRRVNEPGAYDVLIESLSSTFRLVE

SEQ ID NO: 395 - DNA, 2232 bp, Unknown
  misc_feature: Bacterial DNA
atgtctcattccaagaagcttattttaaccggtagtctttcagcggttgcgctttgcgcgatgatgttgacgcccgccaccgccggaaaagccaggtcactgcgaacatctgaacaggccagcgaaatggcggcgaagacgctgtcgcaaatgacggccgaagaaaaaacgatccttacccacgggatcatgcctcttccgcttggacccgaggcacccaaaattcccgacgatgcaattccgggagccggctacattcctggaattccccgccttaatgtcccagcgctgaaagagacggacgcgagcctcggtgtggcctatgccttcggtatccggcaggacggagctacggcccttccttcgggtctcgctatcgcctcgacttggaacgatgagttggccgaggttgcaggtcggatgattggccaggaggcacgcgcgaaaggcttcaatgtcatgttggcgggaggcgtcaatcttgctcgcgaccccagaaacggtcgaaatttcgagtattttggcgaggaccccttgctgagcggtgtcatcgcaggtcggtcgatccgaggtattcaatctaacaacatcatttctacgattaagcactttgcgttgaacggccaggaaaccggccgaaaagtcgtcgactctcggatttcagaaggcgcggccatggagagcgacctgctagccttcaagatcgggattgaactgggaaaccccggttcggtgatgtgcgcctacaatcttgtgaatggacatccatcctgttcaaatgattggcttttgaacaaagttctgaaacaggattgggggtataaaggctttgtcatgtccgactggggcgccgtacccggcctggaggctgcaataaacgggctggatcaacaatctggcgcgcagttggacccagcagtattcttcgatcagcccttggctgaagccggaaggaccgatgccaattatcgcaagcggatcgacgacatgaatcgaaggatcctctgggcaatctattccaacgggctggacgttcaccccgtgacccccggcggggatatcgatttcaccgctaacgccaccattgcgcaaacagtcgccgaacaaggcatcgttctgcttcgcaacgagcggaatattttgcctttggctaggtctgcaaagcgaattatcgtaatcggcggctatgccgatgcaggcgtactgtccggcgccggttcaagccaggtacagggcgaaggtggaccatcagtagtggtgccattagggggcgccacgccgtggtcaggcttcgcgaatcaagcttatcaccgttccgttccggtcgacgcgattaaggcgatggcgccatctgccgaggttcgtttccgcgacggtcgctacctctccgaggccgtcacgcaggcaaagaatgctgatgtcgttattgtgtttgcaacacagtggtccggcgagggcttcgaccagccggatctcgcgctgcctaatggacaagatgcgctgatcgaagctgtggcaaaagcaaatccgaataccatcgtcgttctcgagacaggcgggcctatagtcatgccttggctcgatcacactgcagcagtggtccaggcttggtatccaggcgcgcgcggcggggaggcaatcgcatctgtactgttcggcacagtcagtccgtccggccgtctgccgattactttcccggccagcgaagatcagcttccgcgaccgaagctggacggatttgatacgatcgagccaaatttctcgggcctgtctaccggttattccggggatctcgtggtggactacgacatcgaagggtcggacgtcgggtatcgatggttcgcacgcaaagagcataagccgcttttcccgttcggcttcggcctttcctacacgcaatttgccaactcggggttgcaaaccgacgggcgcgtcgcaaggttctcagtaagaaatgtcggtgacagaagcggtgccgtcgtcacccagctctatctggtgagccgcgccggcgagacgaagcggcgtttgctcggttatcagcgcttggatctcaaggcgggcgaaacgcgaaatgcggtcttgcaaatcgatcaacgcctcctggcggactggaaggacggccagtggacaatcgtggctggtgaatatgaattcgcgctgggggataatgccgagcagctcgagcgatcagtcaaggtacgcctgcctgcccgaacttggcgggactga

SEQ ID NO: 396 - protein, 743 aa, Unknown
  DOMAIN (1)...(743): Bacterial protein
  SIGNAL (1)...(28)
  DOMAIN (86)...(300): Glycosyl hydrolase family 3 N terminal domain
  DOMAIN (371)...(633): Glycosyl hydrolase family 3 C terminal domain
  SITE (364)...(367): N-glycosylation site. Prosite id = PS00001
  SITE (595)...(598): N-glycosylation site. Prosite id = PS00001
  SITE (596)...(621): Sugar transport proteins signature 2. Prosite id = PS00217
MSHSKKLILTGSLSAVALCAMMLTPATAGKARSLRTSEQASEMAAKTLSQMTAEEKTILTHGIMPLPLGPEAPKIPDDAIPGAGYIPGIPRLNVPALKETDASLGVAYAFGIRQDGATALPSGLAIASTWNDELAEVAGRMIGQEARAKGFNVMLAGGVNLARDPRNGRNFEYFGEDPLLSGVIAGRSIRGIQSNNIISTIKHFALNGQETGRKVVDSRISEGAAMESDLLAFKIGIELGNPGSVMCAYNLVNGHPSCSNDWLLNKVLKQDWGYKGFVMSDWGAVPGLEAAINGLDQQSGAQLDPAVFFDQPLAEAGRTDANYRKRIDDMNRRILWAIYSNGLDVHPVTPGGDIDFTANATIAQTVAEQGIVLLRNERNILPLARSAKRIIVIGGYADAGVLSGAGSSQVQGEGGPSVVVPLGGATPWSGFANQAYHRSVPVDAIKAMAPSAEVRFRDGRYLSEAVTQAKNADVVIVFATQWSGEGFDQPDLALPNGQDALIEAVAKANPNTIVVLETGGPIVMPWLDHTAAVVQAWYPGARGGEAIASVLFGTVSPSGRLPITFPASEDQLPRPKLDGFDTIEPNFSGLSTGYSGDLVVDYDIEGSDVGYRWFARKEHKPLFPFGFGLSYTQFANSGLQTDGRVARFSVRNVGDRSGAVVTQLYLVSRAGETKRRLLGYQRLDLKAGETRNAVLQIDQRLLADWKDGQWTIVAGEYEFALGDNAEQLERSVKVRLPARTWRD

SEQ ID NO: 397 - DNA, 1434 bp, Unknown
  Obtained from environmental sample
gtgagcaaccctgccaccccgcccgcagtcggcgtcctcgacgagcgtgcgccgctgaccttcccgccgggcttcctctggggagcggccactgccgcgtaccagatcgaaggggcagcggccgagggtgggcgcaccccgtcgatctgggacaccttcagccacacggagggcaagacggtctccgggcacaccggtgacgtcgcctgcgaccactaccaccggctctccgacgacgtgcggctgatggccgagctggggttgaagtcgtaccgcttctccgtctcctggccgcgggtgcagccgggcgggtcgggaccggtgaacgccgaagggctggacttctaccggcggctggtcgacgagttgctgaccaacggcatcgagccctggatcaccctctaccactgggacctgccccaggagttggaggacgccggcggttggccggcccgggacaccgccgcccggttcgccgactacgcccagctgatggcggacgcgctgggtgaccgggtgaagtactggaccaccctcaacgagccctggtgctcggccttcctcggctacggctccggcgtacacgcgccgggccgctcggacggcgccgccgccgtccaggccgggcaccacctgatgctcggccacgggctcgcggtgcaggcgctgcgcgcggctcggccggaggcgcagctcggcgtgaccgtcaacctgtacccggtcacgccggccagcgacacgcccggcgacgtggacgccgcccggcgcatcgacgggctggccaaccggttcttcctcgacccgctgctgcgcggggagtaccccgcggacctggtcgccgacctggccaaggtgaccgacttcgggcacgtgcgggacggggacctggccgtgatcgccacgccgctggacctggtcggggtgaactactacagccggcacgtggtggccgcgccggcagccggcgaggagccggagaagtactggcgggcgccgtcctgctggccgggcagcgaggaggtccggttcgtcacccggggcgtgccggtgaccgacatgggctgggagatcgacgcacccggcctggtggagacgctgcgccgggtccacgaggagtacaccgacctgccgctctacgtgaccgagaacgggtccgccttcgtcgacgcggtggtcgacggccgggtggacgacaccgaccggctggcgtacttcgacgcgcacctgcgggcctcgcacgaagcgatcagcgccggagtgcccctgcaggggtactttgcctggtcgctgttggataatttcgaatgggcctggggttacaccaagcggttcggcatggtctacgtcgactacgacagccagaagcgcattcccaagtccagtgccaggtggtacgcggaggtgattcgacgcaacggtctggccgcacaataa

SEQ ID NO: 398 - protein, 477 aa, Unknown
  Obtained from environmental sample
  DOMAIN (17)...(474): Glycosyl hydrolase family 1
  SITE (25)...(39): Glycosyl hydrolases family 1 N-terminal signature. Prosite id = PS00653
  SITE (388)...(391): N-glycosylation site. Prosite id = PS00001
MSNPATPPAVGVLDERAPLTFPPGFLWGAATAAYQIEGAAAEGGRTPSIWDTFSHTEGKTVSGHTGDVACDHYHRLSDDVRLMAELGLKSYRFSVSWPRVQPGGSGPVNAEGLDFYRRLVDELLTNGIEPWITLYHWDLPQELEDAGGWPARDTAARFADYAQLMADALGDRVKYWTTLNEPWCSAFLGYGSGVHAPGRSDGAAAVQAGHHLMLGHGLAVQALRAARPEAQLGVTVNLYPVTPASDTPGDVDAARRIDGLANRFFLDPLLRGEYPADLVADLAKVTDFGHVRDGDLAVIATPLDLVGVNYYSRHVVAAPAAGEEPEKYWRAPSCWPGSEEVRFVTRGVPVTDMGWEIDAPGLVETLRRVHEEYTDLPLYVTENGSAFVDAVVDGRVDDTDRLAYFDAHLRASHEAISAGVPLQGYFAWSLLDNFEWAWGYTKRFGMVYVDYDSQKRIPKSSARWYAEVIRRNGLAAQ

SEQ ID NO: 399 - DNA, 1434 bp, Unknown
  Obtained from environmental sample
gtgagcaacccagcaagcccgcccgccgtcggcgtcctcgacgccggtccggccctcaccttcccgcccggcttcctctggggcgcggccaccgccgcgtaccagatcgagggcgcggcgacggagggcggccgtgccccgtcgatctgggacaccttcagccacaccgagggccggacggtggccgggcacaccggcgacgtggcgtgcgaccactaccaccggatgccggacgacgtgcggttgatggccgacctgggcctgcagtcgtaccgcttctcggtgagctggccgcgggtgcagccgggcggcaccggcggggtcaaccaggagggcatggacttctaccgccgcctggtcgacgaactgctcggccacggcatcgagccgtggctgacgctctaccactgggacctgccgcagccgctggaggacgcgggcggctggccggcccgggacaccgccgcccgcttcgccgagtactcccacctggtcgccgaggcgctcggtgaccgggtgaagtacttcaccacgctgaacgagccgtggtgctcggcgttcctcggttacggctccggcgtgcacgctccgggccgtaacgacggcgcggacgcggtccgggccgggcaccacctgatgctgggccacggcctggccgtgcaggcggtgcgggcggcccgcccggaggcgcagctcggcatcaccgtcaacctgtacccggtcaccccggcgagcgaatcggcggcggacgccgacgcggcccgccggatcgacgcgctggccaaccggttcttcctggacccggtgctgcgcggggcgtacccggcggacctcgtcgcggacctgcgtcaggtcaccgacatggggcacgtgcgcgacggtgacctggcgaccatctccaccccgctggacatggtcgggatcaactactacagccggcacgtggtggccgcgcccgtcgagggcgcggagccggagccctactggcgggcgccgtcctgctggccgggcagcgaggacgtgcggttcgtcacccggggcgtcccggtgacggacatggactgggagatcgacgccccgggcctggtggagacgctggagcgggtgcaccgggagtacaccgacctgccgctctacgtcaccgagaacggctcggcgttcgtcgacgaggtcgtcgacggccgggtggacgacccggaccggctggcctacttctccgcgcacctgcgcgcggcgcacgccgcgatcgaggccggcgtgccgctcaagggctacttcgcctggtcgctcctggacaacttcgagtgggcctggggctacacgaagcggttcggcatggtctatgtcgactacgacagccaggcccggatcgcgaagtccagcgccaggtggtacgccgacgtgatccgacgcaacggactgcccgcacaataa

SEQ ID NO: 400 - protein, 477 aa, Unknown
  Obtained from environmental sample
  DOMAIN (17)...(474): Glycosyl hydrolase family 1
  SITE (25)...(39): Glycosyl hydrolases family 1 N-terminal signature. Prosite id = PS00653
  SITE (388)...(391): N-glycosylation site. Prosite id = PS00001
MSNPASPPAVGVLDAGPALTFPPGFLWGAATAAYQIEGAATEGGRAPSIWDTFSHTEGRTVAGHTGDVACDHYHRMPDDVRLMADLGLQSYRFSVSWPRVQPGGTGGVNQEGMDFYRRLVDELLGHGIEPWLTLYHWDLPQPLEDAGGWPARDTAARFAEYSHLVAEALGDRVKYFTTLNEPWCSAFLGYGSGVHAPGRNDGADAVRAGHHLMLGHGLAVQAVRAARPEAQLGITVNLYPVTPASESAADADAARRIDALANRFFLDPVLRGAYPADLVADLRQVTDMGHVRDGDLATISTPLDMVGINYYSRHVVAAPVEGAEPEPYWRAPSCWPGSEDVRFVTRGVPVTDMDWEIDAPGLVETLERVHREYTDLPLYVTENGSAFVDEVVDGRVDDPDRLAYFSAHLRAAHAAIEAGVPLKGYFAWSLLDNFEWAWGYTKRFGMVYVDYDSQARIAKSSARWYADVIRRNGLPAQ

SEQ ID NO: 401 - DNA, 2253 bp, Unknown
  Obtained from environmental sample
atgaatgccacactaagaataagtttaatattattgataatggtttcaggctatgcttgtaataacagttctgagaaaagaaaaaccgatcctcgcattgaggcaatcctgaaacaaatgaccctggaagaaaagatcggccagatgagccaggtgcacagtccgggtggcgatctttccgatggtttcagggcagccatttccgcaggcgaaatcggttcggtgctgaatgaggcaaggcctgaaatggtcagggagatgcagcgtgttgccgttgaagaaagcaggctgggcattccactgcttttcggccgcgacgtgatccatgggtttaaaacaatatttccgatcaatatcgggcttgcggcaactttcaatcctgagcttgttcagcaaggcgctgaaatagcagcacgggaagccaccagtgttggcatcaactggaactttgcccccatgattgacctttcgcgcgatccgcgctggggccgcatggccgaaagttatggtgaagacccgctgatgaacacaataatggggcttgccatgctgcgcggtttccagggcgatgatctgagcctgccacatacaatggcggcctgtgccaaacattttgcaggttatggcgctgccgaaggcggcagggattacaacaccgccagcatccccgaagtggaactatggaacacccatttccctccgttcaaagccctggcagatgccggcgtggccacctttatgaccggtttcaatgagctgaacggcattcctgccacaggcaatgtttttcttttcagagatgttctgaaagaacgctggcagtttgaaggatttgtggtctcggactgggcttccattatcgaaatgactgagcacggattcactgccggcgataaagaagctgcggaaaaagccgtcctggccggcgtagatatggagatggccagcacatcctataaggatcatctaaaggaattggttacatccggaagagttccggaaaaactgcttgatgatgcggttcgaagaatccttaaagtgaagtttgacctgggtttgtttgataatccctacgtggatttggacaaggtgatcacaacacctcccgctgtacatttggaagcagccaggaaaacagcggttcagagctttgttttgttgaaaaatgaaaaccggacgctgccactgaaccacaacattggcagggtagccgtaattggccccatggctcatgaccgttacgagcaactgggaacctgggtttttgacggcgataccaacctgagcatcacacccctgatggcttttgaagaatttctgggtaaagaaagagtacgttttgcaaaaggagtccaaacaacgcggagtttaggaaaagcaggttttactgaagccatagctgcagccaggcagtcggaagccgtggtgatctttgcaggagaagaagcaatacttaccggcgaagcccacagccgggcttatcttgatttgcctggcgcccaaaacgatctgatcagagaaattgccaaaaccggcaaaccggtggttctggtggtgatgactccccgcccgttaacaattggtgaaatttcggaacacgttgatgctgtgctctatgcctggcatccgggaacaatggcagggcctgctttggtggatgtaattttcggcatggaatcaccctccgggaaactgcctgtaaccttcccaaaagctgccggacagattccggtttattatgctcacaaaaacaccggcaggccttttaatcccgatgattttatccccatggaagatattccggtcagaacctttcagacttcgctgggcaacaccagtcattatttggacatcgggttcgacccattatatccctttgggtttggtttgtcctacaccgaattcgaatatgatgagttcaggctttcagccgaaagcataggattgcaggaagcattgagtgtttcggtcaggctgacaaatacaggcgaatttgaagcggaagaagtagttcagttgtacatacgcgatctggttgcttctattacacggccggtaaaagaattaaaggatttcaccagggtcaggctcaagccaggtgaaacaaaaacagtcagtttcgctttgcatccgaaccaactgggcttttacgattctcatggaaactatattgttgagcctggtgaattccaggtttggactggaggtagttcagaagctgagctttacgattttttcactttgactgactaa

SEQ ID NO: 402 - protein, 750 aa, Unknown
  Obtained from environmental sample
  SIGNAL (1)...(19)
  DOMAIN (91)...(315): Glycosyl hydrolase family 3 N terminal domain
  DOMAIN (384)...(634): Glycosyl hydrolase family 3 C terminal domain
  SITE (2)...(5): N-glycosylation site. Prosite id = PS00001
  SITE (21)...(24): N-glycosylation site. Prosite id = PS00001
  SITE (397)...(400): N-glycosylation site. Prosite id = PS00001
  SITE (433)...(436): N-glycosylation site. Prosite id = PS00001
  SITE (620)...(623): N-glycosylation site. Prosite id = PS00001
MNATLRISLILLIMVSGYACNNSSEKRKTDPRIEAILKQMTLEEKIGQMSQVHSPGGDLSDGFRAAISAGEIGSVLNEARPEMVREMQRVAVEESRLGIPLLFGRDVIHGFKTIFPINIGLAATFNPELVQQGAEIAAREATSVGINWNFAPMIDLSRDPRWGRMAESYGEDPLMNTIMGLAMLRGFQGDDLSLPHTMAACAKHFAGYGAAEGGRDYNTASIPEVELWNTHFPPFKALADAGVATFMTGFNELNGIPATGNVFLFRDVLKERWQFEGFVVSDWASIIEMTEHGFTAGDKEAAEKAVLAGVDMEMASTSYKDHLKELVTSGRVPEKLLDDAVRRILKVKFDLGLFDNPYVDLDKVITTPPAVHLEAARKTAVQSFVLLKNENRTLPLNHNIGRVAVIGPMAHDRYEQLGTWVFDGDTNLSITPLMAFEEFLGKERVRFAKGVQTTRSLGKAGFTEAIAAARQSEAVVIFAGEEAILTGEAHSRAYLDLPGAQNDLIREIAKTGKPVVLVVMTPRPLTIGEISEHVDAVLYAWHPGTMAGPALVDVIFGMESPSGKLPVTFPKAAGQIPVYYAHKNTGRPFNPDDFIPMEDIPVRTFQTSLGNTSHYLDIGFDPLYPFGFGLSYTEFEYDEFRLSAESIGLQEALSVSVRLTNTGEFEAEEVVQLYIRDLVASITRPVKELKDFTRVRLKPGETKTVSFALHPNQLGFYDSHGNYIVEPGEFQVWTGGSSEAELYDFFTLTD

SEQ ID NO: 403 - DNA, 2268 bp, Unknown
  Obtained from environmental sample
atgacagacgaaaaattgcaggcactcctgaaagacatgagtctgaaagaaaagatcttccagctggtgcagatccccggcagattctttctggaaaacacggaagacaccggtactgcggtggaggagaatctcaccgcggaagagctgcacctgacgggctgcacgctcagtgtttacggcgcggaggagctgcgaaaaattcagcaggattgcgtgaagaaccatccgcatcatataccgatcctttttatggcggacattattcacggataccgcacgatttatcctatgccgcttgcccagggcgctatgtttgatgattcgctgacagaggaactctgtgccatggcggcggaggaaatgcggctcggaggtgtacacgttacctttgcgccgatgcttgatcttgtgcgcgatgcgcgctgggggaggatcatggaatctaccggagaggaccccatgctgaactgccgcctgggaaaggcgaccgtgcggggcttccgggcaggagagaataaaatccccggggaaaaaggagtagcttcctgtattaagcattttgcggcatacggcgctgcggaggcaggcagggattacaccaacaccgaggtttcggaacatactctgagagaatattatctcaagagctataaggcagcaatcgatgccggcgcagatatggtgatgacgtccttcaacacgctcaacggcatgcccgccacggggaatcgctggctgatgaagcaggtgctgagagacgagtggggatttgacggcgtgctgatctccgactggggcgccatcggggaaatggtacagcacggcgtatgcagggatctgcgtgaagcggcaaagctggccattgaaaatggcgttgatgttgatatgtgttcgcttgcttacgcacggtatctggaggagcttgtcgtttccggtgaagtggacgaagcgctgatagataaatcatgtctgcgggtgctgcggctgaaaaacaagctgggcttgtttgaagatcccttccgcggagcggatgcagttgcagagaaggccaatgtactcagtgcggagcaccgtgcacttgcccgaaaggctgtgacggaaagtcttgtcctgctgaagaatgacggtgacgaagaaaagctcctgcccctgaaaagaggggaaaggctcgcctttgttggcccgtatgcacagagcagggaactgcacagcatgtgggcgattgcaggcagagaggatgactgcgtatctgtgcgcatggcggcggaggagatcgccgcagagcagggattttgtccggaattcgcttccggtgcggtgatgacccgtcgggaagacctcgcaaccgatagccgggagattgccgttgaacaggtgcgccacggtgcgtatcagccagctcttgccgccaatgcggagtcagaaaaactgcttgccgaagcggttgatgtggcgaagcacgccgacaaggtaatcgtatgtatcggagaacaccgccgtatgagcggggaaggtgcaagccgcgccgatatcagcattcccgcaccacagctggaactgctggaaaaagtgtatgccgcgaatcagaatatcgtaaccgtggtattcggcgggaggccgcttgacctgagaaaggtctgtatgtgcagtaaagcggtcctgtttgcctggatgcccggtacggaaggcggacacggcattatggatgtactgacaggaaagtgttgcccctccggtgcactgagtgtgacgatgccgtactgtgtgggacaggcgccgatctgctataaccactacagcacaggccgtgcaaaaccgtatgacacggactatccgatctttatctccgcttatatcgatgtaccgacgggtccgctgttccccttcgggtacggcctcagctatacggagtttgcggtctcccctgtacagcttacgaaggctgccgccgaaagctccggcggcgtgctgacggaagcgcaggtaaacgtaacaaactgcggtgaacgggagggcacagcaatcgtgcagctttatatccgtgatgaagtgtcttcactgatccgcccggtaagggaactgaaagggtatcagcggattccgcttgcatcgggggaaatgaagcaggtcacgtttgaaattacggaagaaatgctggcatttgtaaatgcagataatgtatttgcggcagagccgggtaactttacggtatatatcgggttggattccgatacagacaatgcagcaacgtttaccctgatataa

SEQ ID NO: 404 - protein, 755 aa, Unknown
  Obtained from environmental sample
  DOMAIN (76)...(298): Glycosyl hydrolase family 3 N terminal domain
  DOMAIN (370)...(638): Glycosyl hydrolase family 3 C terminal domain
  SITE (44)...(47): N-glycosylation site. Prosite id = PS00001
  SITE (674)...(677): N-glycosylation site. Prosite id = PS00001
  SITE (746)...(749): N-glycosylation site. Prosite id = PS00001
MTDEKLQALLKDMSLKEKIFQLVQIPGRFFLENTEDTGTAVEENLTAEELHLTGCTLSVYGAEELRKIQQDCVKNHPHHIPILFMADIIHGYRTIYPMPLAQGAMFDDSLTEELCAMAAEEMRLGGVHVTFAPMLDLVRDARWGRIMESTGEDPMLNCRLGKATVRGFRAGENKIPGEKGVASCIKHFAAYGAAEAGRDYTNTEVSEHTLREYYLKSYKAAIDAGADMVMTSFNTLNGMPATGNRWLMKQVLRDEWGFDGVLISDWGAIGEMVQHGVCRDLREAAKLAIENGVDVDMCSLAYARYLEELVVSGEVDEALIDKSCLRVLRLKNKLGLFEDPFRGADAVAEKANVLSAEHRALARKAVTESLVLLKNDGDEEKLLPLKRGERLAFVGPYAQSRELHSMWAIAGREDDCVSVRMAAEEIAAEQGFCPEFASGAVMTRREDLATDSREIAVEQVRHGAYQPALAANAESEKLLAEAVDVAKHADKVIVCIGEHRRMSGEGASRADISIPAPQLELLEKVYAANQNIVTVVFGGRPLDLRKVCMCSKAVLFAWMPGTEGGHGIMDVLTGKCCPSGALSVTMPYCVGQAPICYNHYSTGRAKPYDTDYPIFISAYIDVPTGPLFPFGYGLSYTEFAVSPVQLTKAAAESSGGVLTEAQVNVTNCGEREGTAIVQLYIRDEVSSLIRPVRELKGYQRIPLASGEMKQVTFEITEEMLAFVNADNVFAAEPGNFTVYIGLDSDTDNAATFTLI

SEQ ID NO: 405 - DNA, 2127 bp, Unknown
  Obtained from environmental sample
atgagcgaggaaacgggcaagacgaaccggacccctcggtacacggggaaggcaagctccctcccctcctggaaatccatcctgcgggcggaaggagcggaaagggaggaactcatccgggagctggtccaaggcatgaccctgcggcaaaaggtcaaccagatggccggtcgcatgaccctgttggagatggtcatctccatcttccgctacaactacaagcccttccgagcgggagaggaccgtgggctggggatccctcccctgcgcttcaccgacggcccgcgaggagtagcgctggggaattccacctgctttccggtatccatggcccgggcggcgacctgggacgtcgagttggaggaacggatagccgaggccatgggcgtggaagcccgttcacagggggccgacttcttcggcggggtgtgcataaacctcctccgccatccgggatggggaagggcgcaggagaccttcggggaggacccttacctcctgggagagatgggggcggccatggtcaggggtgcccagaaacacctcatggcctgcatcaagcacttcgcctgcaacagcatcgaggaatcccgcttctacgtggacgtgcgcgtcgacgaacgcaccctgcgggaggtgtacctcccccatttccgacgctgcgtggaggaaggggcggccgccgtgatgagcgcctacaatcgggtcaacggcgaatactgcgcccacaacgctcacctgctgcgggacatcctcaaagacgagtggggtttccggggactggtgatgtccgatttcgtcttcgggacgcgggacacggtcaaggcggcctggggcgggctggacgtcgaaatgccccaagcctggtttttcgggaagaaactgatccgtgcggtgcgccggggagtggtccccgagtccttgatcgacgaggcggtcacccgcattctacgtcagaaggccaggttcgccgccctggaccagggggattacggacctcatcgggtggcctgttccgaacacgccgagctggccctggaggcggcccggaagagtatcgtcctgctgaaaaacgcggacggcatcctacccttggatcctggaaagataaggaaattagcggtcatcgggaaactggccgacctgcccaacatcggggatcgaggctccagccgcgtgcgtcccccctacgtggtgaccatcctgcagggactgcgcaaccgcgccggctcttccctggagattatctaccgggacgggtcggaccttgaagaggcccgcgaggcggcgcgcaccgccgacgcctgcgtggcggtggtgggcttaacctcccgggacgagggggaggccatacccggaccggttaagctcggcggagaccgcgaggacctctccctgcgcccccgggacatcgcccttgtggaagaagttgccacagtgaacccgcgctgcatcgtggtcctggagggaggctcggccgtcctcaccgcgggatggcgggacaaggcggcggctgtcctcatggcctggtacccgggcatggaggggggcaacgcagtggcggacatcattttcggcctggcgaaccccagcggtaaactgccggtgaccttcccggaaagcaacgaccagctacccttcttcgacaagaaggcgggcagcatcgagtacggttactaccacggctatcgtcttttcgacaaggaagggatgcgccccgcttttcccttcggcttcggactcagttacacctcttaccggtatcggaacctgtgcctgagcgcggaggagatgaccccggagggcgccatcctggtggaggcggagatcgtcaacgccggcagcatggccggcgacgaggtggtccagctttatgtgggctatccctcctcgaccgtggaccgtccggtgaaggaattaaaaggattcgcccgcgtgcacctggaacccggagagagcaagcgggtctccttccctctgcgggctgcagacctggcctactacgacgtggaaaggggggcctgggtggtggaggaaacggaatacgaggtgttggtgggttcctcctccgaccccggggacctgcacctgaggggctctttccgcgtgacaggctccacccgatga

SEQ ID NO: 406 - protein, 708 aa, Unknown
  Obtained from environmental sample
  DOMAIN (78)...(286): Glycosyl hydrolase family 3 N terminal domain
  DOMAIN (353)...(585): Glycosyl hydrolase family 3 C terminal domain
  SITE (103)...(106): N-glycosylation site. Prosite id = PS00001
MSEETGKTNRTPRYTGKASSLPSWKSILRAEGAEREELIRELVQGMTLRQKVNQMAGRMTLLEMVISIFRYNYKPFRAGEDRGLGIPPLRFTDGPRGVALGNSTCFPVSMARAATWDVELEERIAEAMGVEARSQGADFFGGVCINLLRHPGWGRAQETFGEDPYLLGEMGAAMVRGAQKHLMACIKHFACNSIEESRFYVDVRVDERTLREVYLPHFRRCVEEGAAAVMSAYNRVNGEYCAHNAHLLRDILKDEWGFRGLVMSDFVFGTRDTVKAAWGGLDVEMPQAWFFGKKLIRAVRRGVVPESLIDEAVTRILRQKARFAALDQGDYGPHRVACSEHAELALEAARKSIVLLKNADGILPLDPGKIRKLAVIGKLADLPNIGDRGSSRVRPPYVVTILQGLRNRAGSSLEIIYRDGSDLEEAREAARTADACVAVVGLTSRDEGEAIPGPVKLGGDREDLSLRPRDIALVEEVATVNPRCIVVLEGGSAVLTAGWRDKAAAVLMAWYPGMEGGNAVADIIFGLANPSGKLPVTFPESNDQLPFFDKKAGSIEYGYYHGYRLFDKEGMRPAFPFGFGLSYTSYRYRNLCLSAEEMTPEGAILVEAEIVNAGSMAGDEVVQLYVGYPSSTVDRPVKELKGFARVHLEPGESKRVSFPLRAADLAYYDVERGAWVVEETEYEVLVGSSSDPGDLHLRGSFRVTGSTR

SEQ ID NO: 407 - DNA, 1308 bp, Unknown
  Obtained from environmental sample
atggcatttccgaaagattttctatggggcgtcgcagcctccagctatcagattgaaggcggcgcgctgacggaagggcggggcgagtgcatctggtacaacttttcgcacacgcccggtaaaacgcaggatggcgacaccggcgacgtggcctgtgaccatctgcacctgtataaggaagatgtgaagctgatggccgacctgggggtgcaggcctaccgattttcggtggcgtggccgcgcgtgatccccgaagggacgggccggatcaacgaacaaggactggacttttatgacaggctggtggacgaactgctcaagtacggcatccagccctggctgacgctcaatcactgggactatccgcaggcactccagaataagggcggttgggcgaacccggacagcgtggaatggttcacggaatacaccaacgtgatgacccgcgcgctgggggatcgtgttcgcggctggattacgcataatgaaccctggtgcgtctcgatcctttcgaatttgctgggcatgcatgcccccggtctgaatgacgcgccaacggcttaccgcgtggcgcaccacctgaacctggcgcacggctcggcgatggccgtgatccgccagaactgtcctggcgtcccggcggggattacactgaacctgtcacctgccgtgccttcgaccgatagtgaggaagatcaacaggcagcacagttctttgacgcgaccttcaaccgctggttcctcgatccggtactgaaaggtagctatccggcggacgggatcgcgatgctgagcgccgcgctggaaggcatcgatctggacgcggttcaggcggccaacgtaccaatggatttcctgggcatcaatttctacaaccgcaatctcatctcggcgagcggcagtcccaagttccccgacaatgcggaattcactgaaatgggctgggaaatttatccgcaagccctgaccgacctgctggtgcgggtgtcccgcgattatgcgccgcccgcgatttacatcacggaaaatggcgcggcgtttgccgatcctgacccggtggacggcattgtcgaagacccacgccgcgtcgaatacctgaaagcccatttccaggccgccgagaacgcgattatccagggcgtgcccctcaaaggctatttcgtgtggagcctgatggacaactttgagtggtcgttcggctacagcaaacgcttcggcatcatccatgtcgattatgcgacgcagaagcggacgcccaagcggagcgctcggttttatcaagaaatgatcgcgcggcagcctgtgtag

SEQ ID NO: 408 - protein, 435 aa, Unknown
  Obtained from environmental sample
  DOMAIN (1)...(435): Glycosyl hydrolase family 1
  SITE (7)...(21): Glycosyl hydrolases family 1 N-terminal signature. Prosite id = PS00653
  SITE (34)...(37): N-glycosylation site. Prosite id = PS00001
  SITE (343)...(351): Glycosyl hydrolases family 1 active site. Prosite id = PS00572
MAFPKDFLWGVAASSYQIEGGALTEGRGECIWYNFSHTPGKTQDGDTGDVACDHLHLYKEDVKLMADLGVQAYRFSVAWPRVIPEGTGRINEQGLDFYDRLVDELLKYGIQPWLTLNHWDYPQALQNKGGWANPDSVEWFTEYTNVMTRALGDRVRGWITHNEPWCVSILSNLLGMHAPGLNDAPTAYRVAHHLNLAHGSAMAVIRQNCPGVPAGITLNLSPAVPSTDSEEDQQAAQFFDATFNRWFLDPVLKGSYPADGIAMLSAALEGIDLDAVQAANVPMDFLGINFYNRNLISASGSPKFPDNAEFTEMGWEIYPQALTDLLVRVSRDYAPPAIYITENGAAFADPDPVDGIVEDPRRVEYLKAHFQAAENAIIQGVPLKGYFVWSLMDNFEWSFGYSKRFGIIHVDYATQKRTPKRSARFYQEMIARQPV

SEQ ID NO: 409 - DNA, 1404 bp, Unknown
  Obtained from environmental sample
atgagcatgcaaagatttcccgaaaacttcacttggggcgccgccactgcctcgtaccagattgaaggaggcgcccaagccgacggacgagccccttccgtttgggacatgatgtgccgctgggagggcaaagttaactccggccattccggcgacgtcgcctgtgaccactatcaccgattccgagaagacgtccgactgatgggcgagcttgggcttcggtcctatcgtttctcatttgcctggccccgtgtgatccccaacgggactggcacggtcaacgaagccggactaggcttctacgaccaactgatcgacgctcttctcgaacagggcatcgaaccgtttcccactctgttccattgggactacccgcttgccctcttcaatcgtggcggatggctcaatcccgactcgccgaagtggtttgccgactacacgtcggttctcgtcgatcgattttcggaccgcatttccaagtggttcaccctaaatgagccgtcctgcttccttggcctgggacacgtcaccggcacccacgccccgggcctcaagctcgactatcccgagtttttcctcggcgtcaagcatgcgatgatgtctcacggaacggcgggccaggtgatccggagccaaagcaaaactccaaaccctcacgtcagcatcgcgccggtcagctcgcttggcgtcccggtcgatgattccgcagagaacatcgtcgccgcgcgggagtacacctttggcgagccgcactcggaccgaggtttctggcacccggcgatctacctcgaccccgtctgcaaaggcgtctggccggagtcgatcgagcgattcctcagctcgaggccaattcccgtctcggcggacgacctgaagacgatgcatcaggtgccggattcgatcgggcttaactactacagcgcggtccgcgtccagtcgatgcccgacggttcgattcggtcgctcctgcacgtccccggccacccgcgaaccggcttcgactggcccgtcgttcccgaaggcatgtattggtcgatccggttccaccacgagcggtacggacttccgtgctacatcaccgaaaacggcctttcgggaatcgattgggtcgccgaggacggcggcgtccacgatccccagcggatcgattacaccgcccgccacctgaaagagcttcttcgcgcccaccatgacggccaccccgtcctgggctacttccattggtcgctgctggacaacttcgaatgggcggaagggtatcgccaccggttcggcctcatccacgtcgactacgaaacccaaaagcggacgatcaaggattcaggccactggtatcgaagagtcgccgattcgaacggctcgatcctaaccgacccccaaggcgacccggtctcgacccgctaa

SEQ ID NO: 410 - protein, 467 aa, Unknown
  Obtained from environmental sample
  DOMAIN (3)...(454): Glycosyl hydrolase family 1
  SITE (9)...(12): N-glycosylation site. Prosite id = PS00001
  SITE (10)...(24): Glycosyl hydrolases family 1 N-terminal signature. Prosite id = PS00653
  SITE (89)...(92): N-glycosylation site. Prosite id = PS00001
  SITE (236)...(248): EF-hand calcium-binding domain. Prosite id = PS00018
  SITE (362)...(370): Glycosyl hydrolases family 1 active site. Prosite id = PS00572
  SITE (458)...(461): N-glycosylation site. Prosite id = PS00001
MSMQRFPENFTWGAATASYQIEGGAQADGRAPSVWDMMCRWEGKVNSGHSGDVACDHYHRFREDVRLMGELGLRSYRFSFAWPRVIPNGTGTVNEAGLGFYDQLIDALLEQGIEPFPTLFHWDYPLALFNRGGWLNPDSPKWFADYTSVLVDRFSDRISKWFTLNEPSCFLGLGHVTGTHAPGLKLDYPEFFLGVKHAMMSHGTAGQVIRSQSKTPNPHVSIAPVSSLGVPVDDSAENIVAAREYTFGEPHSDRGFWHPAIYLDPVCKGVWPESIERFLSSRPIPVSADDLKTMHQVPDSIGLNYYSAVRVQSMPDGSIRSLLHVPGHPRTGFDWPVVPEGMYWSIRFHHERYGLPCYITENGLSGIDWVAEDGGVHDPQRIDYTARHLKELLRAHHDGHPVLGYFHWSLLDNFEWAEGYRHRFGLIHVDYETQKRTIKDSGHWYRRVADSNGSILTDPQGDPVSTR

SEQ ID NO: 411 - DNA, 2553 bp, Unknown
  Obtained from environmental sample
atgtcatgttttgctaaacgttttacccctaaactgctgactgtgctgactacctttatcgccatggcgtgttttgccggcgggcaggctcccggcaactggccgcgtgtgcagagtgcgttgcaacccgatccccttatcgagcaacaaattgattctttgttggctaagatgaccattgagcaaaaggttgctcagttgatccaaccggaaattggctatctgaccgttgcgcaaatgcgccaatacggttttggctcttatctcaatggcggtaatactgcaccctttggcaacaagcgggctgaggtagcgacctggttgcagttagctgatgcgatgtatctggcatcggtagacagtagcctggatggtagcagtattccaaccatctggggcactgatgccatgcacggccacagtaatgtttatggcgcaactttatttccgcataacattggcctgggtgcggcccgggatccagatctaatccgccagatcggcgaagccacggcgaaagaagttgcagtaaccggcattgaatggacctttgcaccgacggtggctgtggtgcgcgatgatcgctgggggcgcacttatgaaagctactcagaggatcctgccattgttgctgagtatgccggccctatggtcagtggtttgcaaggggaaattggcgatcattttttacacgggcattatcggatcgctaccgctaagcattttatcggtgatggcggtacggaaaatggtctggatcgcggagataccttactggatgaaaagcgcctgcgcgaaatccatgctgcgggttactacacggcgatcgctgccggcgtgcagtcggtgatggcctcgtttaacagttggaatggtaagcgggtgcatggtgatcattacctgttaaccgaggtcttgaaaaaccaaatggggtttgacggttttgtgatcagcgattggaatgcgcataagtttgttgatggttgcgatctggagcagtgtgctgcggcttttaatgctggcgtagatgtgatgatggtaccggaacattttgaggctttctatcacaatacggtacagcaagtgaaagacggactgatcccgatgacgcggctggatgatgcggtacgccgctttttacgcgccaaaatccgctgggggttgtttcagcgcggtaaaccttccagccgtcctgaatcattacaaacgcagtggtttaatgcacctgagcatcgtgagttagcacgacgggcggtgcgacaatcgctggttttgctgaaaaataaccggcagttgctgccgttaaacccaaacagtcgggtgctgattgccggcgacggcgccgataatattgctaaacaagccggtggctggagtgtttcctggcaaggcaccgataacagcaatgccgatttcccgaatgcgacctccatttatcaggggttacggcagcaaattcttgctgctggcggtagcgttgaactgagtgtcgatggtcactttacggagaaaccggatgtcgccatagtggtgattggcgaagaaccttacgcggaatggtatggtgatattcagcggctggaatatcagtacgacaataagcaggatctggcgttactaaagcggttacaggctcaggcgatcccggtagttacggtgttcttaagtggccgcccgctctggataaataaggaactgaacgcatctgacgcctttgttgcagcctggttgccaggttcggaagggcagggtgttgccgatgtcttattgcgtgatagacagggtgagatccagttcgactttagcggaaaacttagcttctcctggccaaaattcgacgatcagtttttactgaacgtgcacgataaggtctatgatccactctttgcttacggttatggcctgacctacgctgatcaggtgcagcttgcccgagtacatgaacaaaccagtccggcgtcgcaaacaccgactggcagcgggcaagctttgtttgtgcgcaatctggcagatggcctgcagtggcaactggtcgacagccatatggataaactgacgaccaccagttctgcagcagtgagtgctgatggtcgtagtgtattgatgcaatcggtaaatctggcctatcaggaagatggtcgtaaatttgtctggaatgccgggcagcggccggcctccgcccgtttacagtacatcaagccgcaagtaatgcccagacagcagagtgtgcaatggttgcaaatgagtatccggctggatcaagcgccaagcggcggggtgcaattacagctgctatgtcagcagcagaactgtgtgcactcggcgtccttattaccgctgctcgctggtctgaagcggggacaatggtataggatggcgtggccgcttaattgcgcggggcagcccgttatggcggctagccagccagcatcgggtctggttgaggatctaatacgtttaaatgccagcggcgagtttagtctggcgatcgccgaggtggcgctggtggaacatactgcggaagatgcactgctacaggggtgtcagccttag

SEQ ID NO: 412 - protein, 850 aa, Unknown
  Obtained from environmental sample
  SIGNAL (1)...(26)
  DOMAIN (124)...(347): Glycosyl hydrolase family 3 N terminal domain
  DOMAIN (423)...(639): Glycosyl hydrolase family 3 C terminal domain
  SITE (309)...(326): Glycosyl hydrolases family 3 active site. Prosite id = PS00775
  SITE (481)...(484): N-glycosylation site. Prosite id = PS00001
  SITE (575)...(578): N-glycosylation site. Prosite id = PS00001
  SITE (833)...(836): N-glycosylation site. Prosite id = PS00001
MSCFAKRFTPKLLTVLTTFIAMACFAGGQAPGNWPRVQSALQPDPLIEQQIDSLLAKMTIEQKVAQLIQPEIGYLTVAQMRQYGFGSYLNGGNTAPFGNKRAEVATWLQLADAMYLASVDSSLDGSSIPTIWGTDAMHGHSNVYGATLFPHNIGLGAARDPDLIRQIGEATAKEVAVTGIEWTFAPTVAVVRDDRWGRTYESYSEDPAIVAEYAGPMVSGLQGEIGDHFLHGHYRIATAKHFIGDGGTENGLDRGDTLLDEKRLREIHAAGYYTAIAAGVQSVMASFNSWNGKRVHGDHYLLTEVLKNQMGFDGFVISDWNAHKFVDGCDLEQCAAAFNAGVDVMMVPEHFEAFYHNTVQQVKDGLIPMTRLDDAVRRFLRAKIRWGLFQRGKPSSRPESLQTQWFNAPEHRELARRAVRQSLVLLKNNRQLLPLNPNSRVLIAGDGADNIAKQAGGWSVSWQGTDNSNADFPNATSIYQGLRQQILAAGGSVELSVDGHFTEKPDVAIVVIGEEPYAEWYGDIQRLEYQYDNKQDLALLKRLQAQAIPVVTVFLSGRPLWINKELNASDAFVAAWLPGSEGQGVADVLLRDRQGEIQFDFSGKLSFSWPKFDDQFLLNVHDKVYDPLFAYGYGLTYADQVQLARVHEQTSPASQTPTGSGQALFVRNLADGLQWQLVDSHMDKLTTTSSAAVSADGRSVLMQSVNLAYQEDGRKFVWNAGQRPASARLQYIKPQVMPRQQSVQWLQMSIRLDQAPSGGVQLQLLCQQQNCVHSASLLPLLAGLKRGQWYRMAWPLNCAGQPVMAASQPASGLVEDLIRLNASGEFSLAIAEVALVEHTAEDALLQGCQP

SEQ ID NO: 413 - DNA, 2223 bp, Unknown
  Obtained from environmental sample
atgaaatatctacgacccctatcagtattcctgtgtctcgtcgtcgttcttgcgctgttgttatcgacgccgcccagttcggcgcaacgcagggatgacatcgagggacgcgtaaacgcgctgctggcccagatgtcgctgagcgagaagttgggccaactccaacaactcgacggcgaaggaaatggaaacttccgccccgaacacctcgagctcgctcgcaaaggtctgctcggttcgacgctaaacgttcgaggcggcggacgtccgaatcaacttcagcgcgtcgcggtggaacagtcgcgtctgaagattccgctgttgttcggtttcgacacgattcacggttatcgcactatctttccgataccactcgcggaagcggcgagttgggagccgtcgctggcggaacgctccgctagtattgcagcgaaagaggcgtacgccgccggcctgcgctggacattcgcgccgatggtcgacatcgcgcgcgatccgcgttggggaagaatcaccgaaggcgccggtgaagatccgttcctgggcgccgccttcgcgcgagcgcgcgtgcgcggctttcaaggcgacgactattcacaacccggcaagatactcgcctgcgcgaaacattgggtcgcctacggcgcggctgaaggtggacgcgactacaacacgaccgagatgtctgaacagacgctgcgctcgatctatttcccgccgttcaaagcggcggtggatgcgggcgtcggaacgttcatgagtgctttcaacgcactaaacggcgtcccaacttcggcgaaccatttcacgttgacgaaagtcctgcgcgatgagtggaagtttagcggttttgtcgtcagcgactacacgtccgtgaaggagctcatcaatcacggctacgcggcaaacgataaggaagccgcgtggtttgcgttgaacgccggcgtcgacatggagatggtcagccgtctgttcaatcaacacggaacggaactgctgcaagagcaaaaatggtcgccggcaacgctcgacgaagcagtgcgcaggattctgcgaatcaagtttcgcctcggccttttcgagcggccttatgtcgacgaatcgctggaaaagactgcgtacttaactgccgaaagtcgcgcggtggctcgtgaagtcgcaagcaagtcgatggtgctgttgaaaaacgagcgcgacacgttgccactcgcaaagacgatccaatcgattgctgtaattggaccattggctgacgacaaacgctcgccgctgggttggtggtccggcgacggccgcgatgaagacactgtcacgcctcttaccgggatcaagaacaaagtctctgcacaaacgaaggtgacatacgcaaaaggctgcgacgtgacgggcgattccgatgcagggtttgcggaagcagtcgcagcggcgcgaaactctgacgtgacgatcgtcttcgtcggtgaatcgaaagacatggttggcgaggccgcttcgcgcgcgacgctcgatcttccgggacggcagatggacctcgtgcgggaagtctcacgcgcaggcaaacccacgattgtcgtgctggtgaacggccggccgccggcgatcggttggattgtagataacgtcccggcgattctcgaatcatggatgggtgggaccgaatccggaaacgcgattgccgacgtgctcttcggcgacgtgaatccgggcggtaagctgccggttacgtttcctcgtgttaccggtcaggtgccgattcattacaaccacctgaacacgggccgtccacctgaagcgaacaatcgttacacgtccaagtatttcgacgcgccgtggacgccgcagtttcctttcggtttcggcttgagcttcacgcagttcaggatctcgaacgtgggaattagcgcgacgcagattggaccggacggcacgattcgcgtcactgcggacgttgagaatgtcggtagacgcgccggcgatgaggtggtccaactctacgttcgcgacgttgcggccagcatctcgcgccccgtgaaagaactaaaaggctttcaacgcgtaactctgcaacccgggcagaagcgaagcctggagttcgttctcgggcccgaacatctcggcttctacaatcgcgatatgaagtttgtcgtcgaacccggcgagtttcgcgtgatggtcggtgcgaactcgcaggacgtgatcgagaagacgtttgcagtcagataa

SEQ ID NO: 414 - protein, 740 aa, Unknown
  Obtained from environmental sample
  SIGNAL (1)...(28)
  DOMAIN (97)...(321): Glycosyl hydrolase family 3 N terminal domain
  DOMAIN (391)...(625): Glycosyl hydrolase family 3 C terminal domain
  SITE (227)...(230): N-glycosylation site. Prosite id = PS00001
  SITE (278)...(295): Glycosyl hydrolases family 3 active site. Prosite id = PS00775
MKYLRPLSVFLCLVVVLALLLSTPPSSAQRRDDIEGRVNALLAQMSLSEKLGQLQQLDGEGNGNFRPEHLELARKGLLGSTLNVRGGGRPNQLQRVAVEQSRLKIPLLFGFDTIHGYRTIFPIPLAEAASWEPSLAERSASIAAKEAYAAGLRWTFAPMVDIARDPRWGRITEGAGEDPFLGAAFARARVRGFQGDDYSQPGKILACAKHWVAYGAAEGGRDYNTTEMSEQTLRSIYFPPFKAAVDAGVGTFMSAFNALNGVPTSANHFTLTKVLRDEWKFSGFVVSDYTSVKELINHGYAANDKEAAWFALNAGVDMEMVSRLFNQHGTELLQEQKWSPATLDEAVRRILRIKFRLGLFERPYVDESLEKTAYLTAESRAVAREVASKSMVLLKNERDTLPLAKTIQSIAVIGPLADDKRSPLGWWSGDGRDEDTVTPLTGIKNKVSAQTKVTYAKGCDVTGDSDAGFAEAVAAARNSDVTIVFVGESKDMVGEAASRATLDLPGRQMDLVREVSRAGKPTIVVLVNGRPPAIGWIVDNVPAILESWMGGTESGNAIADVLFGDVNPGGKLPVTFPRVTGQVPIHYNHLNTGRPPEANNRYTSKYFDAPWTPQFPFGFGLSFTQFRISNVGISATQIGPDGTIRVTADVENVGRRAGDEVVQLYVRDVAASISRPVKELKGFQRVTLQPGQKRSLEFVLGPEHLGFYNRDMKFVVEPGEFRVMVGANSQDVIEKTFAVR

SEQ ID NO: 415 - DNA, 1101 bp, Unknown
  Obtained from environmental sample
atgctgataattggaggccttcttgttttactgggattttcttcttgcgggcggcaggcagaacctgctgctgactctttcagggggtttcatgactttgacatcaggcgtggggtgaacatcagccactggttgtcgcagagtggaaggcgtggtgctgatcgggaggcgttctttaccagggcggatgtggaggccatcgccggcttcggttatgatcacattcgtttgcccattgatgaggagcagatgtgggatgagtcgggcaacaaggaaccacgtgcctttgaattgctgcatgaagccattggctgggctttggacaatgagctcagggtcattgtcgacctgcacatcatcaggtcgcactattttaatgcgcctgagaacccgctttggaccgatcgtgctgaacagttgaaatttgttgagatgtggcgacagttgtctgatgagctgcagggctatccgctcgatagggtggcctatgaattgatgaatgaggccgtggctgatgatccggacgattggaaccggcttgtggctgagacgatggaggcgctacggatgctggaaccggagcgcaagattgtcattggctccaaccgctggcagtctgtgcatacatttcctgacctggtgatcccggataatgacccgcatatcatattgagttttcacttctacgaaccatttctgctgacgcaccacaaggcctcctggacacacatccgtgattacaccggtccggtgaactatccgggtttgactgtagacccgacccacctggaggggttgtctgaagaactggtgacccggattggccatcacaatggggtgtatacaaaagaaacgatggaggagatgatcatgatcccactgcaatatgccaaagaccgggggctccccctttattgtggagagtggggatgtttcccgaccatgccccaggagatgcgcctgcaatggtacgccgatgtgcgtgcgatcctggaaaagcatgagattgcctgggcaaactgggattacaagggtggtttcggtgtggttgaccgcaacggcgaaccccaccatgatttattggaagtgctcttaaaataa

SEQ ID NO: 416 - protein, 366 aa, Unknown
  Obtained from environmental sample
  SIGNAL (1)...(20)
  DOMAIN (42)...(349): Cellulase (glycosyl hydrolase family 5)
  SITE (40)...(43): N-glycosylation site. Prosite id = PS00001
MLIIGGLLVLLGFSSCGRQAEPAADSFRGFHDFDIRRGVNISHWLSQSGRRGADREAFFTRADVEAIAGFGYDHIRLPIDEEQMWDESGNKEPRAFELLHEAIGWALDNELRVIVDLHIIRSHYFNAPENPLWTDRAEQLKFVEMWRQLSDELQGYPLDRVAYELMNEAVADDPDDWNRLVAETMEALRMLEPERKIVIGSNRWQSVHTFPDLVIPDNDPHIILSFHFYEPFLLTHHKASWTHIRDYTGPVNYPGLTVDPTHLEGLSEELVTRIGHHNGVYTKETMEEMIMIPLQYAKDRGLPLYCGEWGCFPTMPQEMRLQWYADVRAILEKHEIAWANWDYKGGFGVVDRNGEPHHDLLEVLLK

SEQ ID NO: 417 - DNA, 2184 bp, Unknown
  Obtained from environmental sample
atgaacaagaaacaaagcgaattcatccaaccagagatcgaagcgaagatcgatgctttgctggaaaaaatgaccctgctcgaaaaagtggggcagctcacgcagttgggaccatccatggtcggcggtttcgatatggatgcctttttggataaccccgagttgttcaaaagcgccaaacgcgactttcatgaggactggatcatcaaaggcgaagtcggttcctatctcggcgtgcaaggtgcggaagagatcaaccgcctgcaaaagattgccgtcgaaggatcgcggctgggcattcccctcctcttcgggttggatgtgatccacggctaccgcaccatctttccgatcccactggcggagacgtgcagttgggaaccggaactggcacgcagaacggcggaagtcgccgcacgcgaagcctccgctgccggtctgcattggaccttcgcgcccatgatggatatcgcccgcgatgcgcgctggggacgcattgccgaaggctccggcgaagatccgttcctgggcagcctctttgctgcggcgcgtgtgcgtggattccagggagatgacctcagcgatccgcagcatgtggctgcctgtgccaagcattacattgcctatggtgcggcggtcgctggtcgcgattacaacacggtcgagatggcggagcaaaccctgcatgaggtctatctgccgccgttcaccgccgccgtagaagagggtgtgctgacctttatgagcgccttcaatgatctgaacggtgtccctacctctgccaaccggtacaccctcaccgatattttgcgcggcaaactgggcttcaacggtcttgtcgtcagcgattcgggctccgtcggtgaactggtcgcgcacggatacgccgccgaccgcaaggatgccgggaagaaggcgctgctcgccggtgtggatatggacatggtcagcgagagttaccgcttcgacatccccgacttggtggaagcgggcatcgtgccgctctccattgtggacgaggcagtgcggcgaatcctgcgcgtcaaattcctattgggcttgttcgagcacccataccgctccaacgctgacgaggaatccgcggcgcagctgaccgccgaacatctcgccgtggcacgcgagtcggcgcggcgttcgatcgtcctgttgaagaatgagggcggaattttgcccatcaaggagaatcagaagatcgccctcatcggtccattcgcggataatcaggcagacatgctcggctcgtggtcgtttaccggagcggcgaaagatgtcgtcacgatcctcagcgggatacaagccgctgcgaaagcggaagtgctttactcacagggatgcgatgctaagggagaacaacccgccgatttcactcatgccgttgaaaccgctcaacaggcggatgtcattgtcgcggttgtcggtgaaccgatgggcatgagcggagaagccgccagccgcatgcatctcggtctgaccggtcagcaggaagcgctgctggaagcgttgaaagcgacaggcaaaccgctggtcgtgcttctgagcaacgggcgtccacttacggtcccgtgggttgccctccatgccgatgcgatcctggagacctggcagcttggcatacaagccggtcacgccgtggcagatgtgctcttcggcgcctacaacccgagcggaaaactcgccgccactttcccctattcggtggggcaatgcccgatctattacagccacccgagcacgggacgtcccgccaccgatttctatttcacgtccaagtacaatgatggtccggtgaagccgctgtacccgttcggcttcgggttgagctacaccacgttcgaatattccaatctgaaggttagcgcggatgctgaaaaagtgatggtcagcgctgtggtgaagaattccggcagcctggcaggggaggaagtggttcagttatatgtccaggatgtggttggcagccgcgtgcgcccggtgaaggaattaaaaggcttccagaagatcatgctgccagcgggggaagattgcacagtgaccttcgggttgaacgtctctgacctgggcttctacgatgtggacatgaaatatgtcgtcgagccgggacagttcaaggtttgggtgggcacgaactcagcagaaggcttggaaggcgaattcaggttataa

SEQ ID NO: 418 - protein, 727 aa, Unknown
  Obtained from environmental sample
  DOMAIN (92)...(316): Glycosyl hydrolase family 3 N terminal domain
  DOMAIN (387)...(617): Glycosyl hydrolase family 3 C terminal domain
  SITE (273)...(290): Glycosyl hydrolases family 3 active site. Prosite id = PS00775
  SITE (699)...(702): N-glycosylation site. Prosite id = PS00001
MNKKQSEFIQPEIEAKIDALLEKMTLLEKVGQLTQLGPSMVGGFDMDAFLDNPELFKSAKRDFHEDWIIKGEVGSYLGVQGAEEINRLQKIAVEGSRLGIPLLFGLDVIHGYRTIFPIPLAETCSWEPELARRTAEVAAREASAAGLHWTFAPMMDIARDARWGRIAEGSGEDPFLGSLFAAARVRGFQGDDLSDPQHVAACAKHYIAYGAAVAGRDYNTVEMAEQTLHEVYLPPFTAAVEEGVLTFMSAFNDLNGVPTSANRYTLTDILRGKLGFNGLVVSDSGSVGELVAHGYAADRKDAGKKALLAGVDMDMVSESYRFDIPDLVEAGIVPLSIVDEAVRRILRVKFLLGLFEHPYRSNADEESAAQLTAEHLAVARESARRSIVLLKNEGGILPIKENQKIALIGPFADNQADMLGSWSFTGAAKDVVTILSGIQAAAKAEVLYSQGCDAKGEQPADFTHAVETAQQADVIVAVVGEPMGMSGEAASRMHLGLTGQQEALLEALKATGKPLVVLLSNGRPLTVPWVALHADAILETWQLGIQAGHAVADVLFGAYNPSGKLAATFPYSVGQCPIYYSHPSTGRPATDFYFTSKYNDGPVKPLYPFGFGLSYTTFEYSNLKVSADAEKVMVSAVVKNSGSLAGEEVVQLYVQDVVGSRVRPVKELKGFQKIMLPAGEDCTVTFGLNVSDLGFYDVDMKYVVEPGQFKVWVGTNSAEGLEGEFRL

SEQ ID NO: 419 - DNA, 2277 bp, Unknown
  Obtained from environmental sample
atgtccgatattcacgcgctcgtagccagtatgaccttagaagaaaaagcggcgctctgcaccggagccagcgcctggacgacaacgccggtcaaacggctcaacctgcccgaactgctcgtctccgatgggccgcacggcatccgccgcatcgccgacgtttacgccatggcccagcaaagcctgcccgccacctgcttccccaccgcctccagcctggccgccacctgggatggtgatttgctgttccagatggggcaggcgttggccgaagaggccatcgccctgggcgtggacgtcatcctcggccccggcgtcaacatgaaacgctcgcccctctgcggccgcaactttgaatacttctccgaagacccattccaggcgggggcgatggccgccagcctgatcaaaggcattcagagcaagggcgtcggcacgtcgctgaagcattacgccgccaacaaccaggaatttgaacgcttttcgatcaacgcccaggtggacgaacggacgctgcgcgagatttatttaccggcgtttgaaacggccgttacccaggcccaaccctggaccgtcatgtgttcctacaacaaaatcaacggaacctacggctccgaacacacccaactgctcagcgacatcctcaaaaaagagtggggcttccagggcttcgtcgtctccgactggggcgctgtccacgaccgggtggccgccctcaaagccgggctagacctggaaatgcccggccccaaacagacgcgggtcaacgccgtcatcgaggcggtgcgcaacggcgaactggacgaagcgacgctggacgaagccgtccggcgcatcttgcgcgtcaccctctgcgccgcgcaaacgcccaagggcggcgagtttgacgccgccgcccaccacgccctggcccgcaaagtggccgccgagggcatggtcctcctcaagaacaacggcctgctgcccctgcaaaacccgcagcacatcgccgtcatcggccgcgccgcgcaaaaagcccacttccagggcggcggcagctcgcacatcaaccccacccaggtagacgtgcccttcagcgaactgcaaaagctggccgacaacgccgaactgagcttcgccgccggctatcccgaagacgacagccgggaccaggcgctcattgacgaagcgaccgccatcgcccaaaccgccgatgtggccctgctctacatcgctctgccctccttcaaggaatcggaagggtacgaccgaccagacctggacctgacggcgcagcaggtggccttgattcaggcggtaacggccgttcaacccaacaccgtcgtcatcctcaacaacggcgccccggtcgtcatgggcgaatggcttgatggggcggcggccgtgctggaagcgtggatgatgggtcaggcgggcggcggagccatcgccgacgtcctgtttggtcgggtcaaccccagcggcaaactggccgaaacctacccccaccgcttaaccgacacccccgcctatctcaacttccccggcgaaaacggcgtggtgcgctacggcgaagggctgttcatcggctaccgctactacgacgccaaagagatgcccgtcctgttcccctttggctacggcctcagctataccagcttcgcctatagcaatttgcgcgtctcgaccgacagcttccgcgacgtagacggcctcatcgtctcggtagacgtgaccaacaccggcgcggtggcgggcaaggaagtggtgcagctctacgttcgtgaccaggaggcgcggctggtgcggccggtcaaagaactcaaaggcttcgccaaagtcgccctacaaccgggcgagacccaaaccgtcaccatcccgctcgacttccgcgccttcgcctactatgatcccgcctatcggcaatggatcgccgaagaggggcaattcgacattctggtgggcgcgtcggcgaccgatattcgctgccaaacggccgttaccctgcactccaccgcccagttgcccaccatcctccacgaagaatccaccatccgccactggttcaacgacccggccgggaaaaccattctccagcccatgttcgccgaactcatggccaacggccccttcagccaggacgaatccggccaggacgccatcggcatggacacgctcagtttcctgatggatttgcccctgcgcagcttcctccatttccaggaaggctcgctcacccagcccgccgacgacatcgccgacatgctgctggagcaggtgcgcggcgtgaagcactaa

SEQ ID NO: 420 - protein, 758 aa, Unknown
  Obtained from environmental sample
  DOMAIN (28)...(248): Glycosyl hydrolase family 3 N terminal domain
  DOMAIN (312)...(524): Glycosyl hydrolase family 3 C terminal domain
  SITE (203)...(206): N-glycosylation site. Prosite id = PS00001
  SITE (217)...(234): Glycosyl hydrolases family 3 active site. Prosite id = PS00775
MSDIHALVASMTLEEKAALCTGASAWTTTPVKRLNLPELLVSDGPHGIRRIADVYAMAQQSLPATCFPTASSLAATWDGDLLFQMGQALAEEAIALGVDVILGPGVNMKRSPLCGRNFEYFSEDPFQAGAMAASLIKGIQSKGVGTSLKHYAANNQEFERFSINAQVDERTLREIYLPAFETAVTQAQPWTVMCSYNKINGTYGSEHTQLLSDILKKEWGFQGFVVSDWGAVHDRVAALKAGLDLEMPGPKQTRVNAVIEAVRNGELDEATLDEAVRRILRVTLCAAQTPKGGEFDAAAHHALARKVAAEGMVLLKNNGLLPLQNPQHIAVIGRAAQKAHFQGGGSSHINPTQVDVPFSELQKLADNAELSFAAGYPEDDSRDQALIDEATAIAQTADVALLYIALPSFKESEGYDRPDLDLTAQQVALIQAVTAVQPNTVVILNNGAPVVMGEWLDGAAAVLEAWMMGQAGGGAIADVLFGRVNPSGKLAETYPHRLTDTPAYLNFPGENGVVRYGEGLFIGYRYYDAKEMPVLFPFGYGLSYTSFAYSNLRVSTDSFRDVDGLIVSVDVTNTGAVAGKEVVQLYVRDQEARLVRPVKELKGFAKVALQPGETQTVTIPLDFRAFAYYDPAYRQWIAEEGQFDILVGASATDIRCQTAVTLHSTAQLPTILHEESTIRHWFNDPAGKTILQPMFAELMANGPFSQDESGQDAIGMDTLSFLMDLPLRSFLHFQEGSLTQPADDIADMLLEQVRGVKH

SEQ ID NO: 421 - DNA, 2253 bp, Unknown
  Obtained from environmental sample
atgcaagcagtgtcctggccatcgctgaccagcgcggtacccaaacaatccgaaacagaagcacagattgatgagttgctggcgcgcatgaccctggaggaaaaggtcggccagctgatccagccggaactgcgccatgtcacgccggaagacgtcagggaatttcatctgggttcggtactcaacggcggcggttcgtttcccaatggcgatcagtacgccccggtcagcgactgggtcgcggtggccgacggcttctatgaagcctccgtggacacccggggaggccgtaccggtattcccatcatgtggggcacggacgcggtgcatggcctgggcaatgtcatcggcgcgaccctgtttccccacaatatcgccctgggcgccgcccgcgatcccgaactgattcgggccatcggcgaggtgaccgcgaaggaaatagccattaccggcctggactggaacttctcgcccaccgtggcggttgcccgggatgagcgctggggccggacctacgaggcgtactccgaggacccggaaatcgtggcgcagtacgcgggcgagatggtcaaaggcctgcagggtgagccggggaccggggagtttctgcgcgactggcgcgtggtggcgacggcgaaacattttattgccgatggcggcaccattgacggtatagacagaggcgacaataccgacccggaagaaaagctccgggatattcacggcccgggctacttcagtgccatcgaggcgggcgtgcaggtggtgatggcctccttcagcagttggcacggcgagcccatgcacggccacaaatacctgttgaccgatgtcctcaaggggcaactgggctttgatggcgtggtgctgggcgactggagcggccacgggtttattcccggctgtaccgccctcgattgtccggatgccctgctggcgggcctggacgtgtatatgattccggacccggagtggaagcagctttactacaacctgattgaccaggtgcgggggggaattattccccaggcgcgcctggacgatgcggtgtgccgcatgctgcgggtgaaaatgcgcgcgggcatgttcgacaaggccaggccctcccgacgcccctgggccaaccgggccgacaggctgggctcgcccgagcaccgggccgtggcccgccgggcggtgcgtgaatccctggtgatgctgaaaaaccgcggcaacctgctgcccctggcccccaaccagcgggtgctggtggccggggacggcgcccacaatatcggcaagcaggcgggtggctggagcgtgacctggcaggggacgggtaccaccaaagaggattttcccggcgccaccaccatcttcgagggcatcgcgcaggtggtgaacgccgccgggggcgaggcggtgttgagcggggacggcagctttgaccagcgcccggatgtggccattgtggtgttcggggaagacccctacgccgagatgcagggggatatggccaacaccctgtacaagccgggcgacgactcggatctggcgctgctgcgccggttgcgggcccaggagattccggtggtggccctgtttatcaccggccggcccctgtgggtgaaccgcgagctcaacgcctccgacgcctttgtggtgatctggcaaccgggcaccgaaggtggcggtgtggccgatgtcctcttcggtgacagtgaggggcgggctcgtcaccccatgcgggggcgcctgacgtttacctggcccaggcgcccggatcaggggcccgtcaatcgcggcgacgaagattatgacccgctgttcccctatggttttggcctgggctatggcgacccggatacgctggggcaattgccggaagagggcgtggcggtagcggcaacccccgatgtgctggatatcttctatcgccggcccatggggccctggcagttggagatcgagggccggctcaacgaccgggtggccatgaccggcagccgtgccgacacctccacggtcggcgtcgacgccgtggaccgggaggtgcaggaggatgcccgccatgtggtctggagcggcgagggctttggcaggctggcgctggcatccgccaagcgcgtggacctgagcgactacctgggcgccaacgccgccctggtgtttgatgtcaaggtgcacaaggcgcccactcgtaccctgtggctgcgtctggcgagcgcctcctgctgccacgccgatatcgacgtgaccgacgaattctttgga

SEQ ID NO: 422 - protein, 751 aa, Unknown
  Obtained from environmental sample
  DOMAIN (93)...(320): Glycosyl hydrolase family 3 N terminal domain
  DOMAIN (397)...(613): Glycosyl hydrolase family 3 C terminal domain
  SITE (549)...(552): N-glycosylation site. Prosite id = PS00001
MQAVSWPSLTSAVPKQSETEAQIDELLARMTLEEKVGQLIQPELRHVTPEDVREFHLGSVLNGGGSFPNGDQYAPVSDWVAVADGFYEASVDTRGGRTGIPIMWGTDAVHGLGNVIGATLFPHNIALGAARDPELIRAIGEVTAKEIAITGLDWNFSPTVAVARDERWGRTYEAYSEDPEIVAQYAGEMVKGLQGEPGTGEFLRDWRVVATAKHFIADGGTIDGIDRGDNTDPEEKLRDIHGPGYFSAIEAGVQVVMASFSSWHGEPMHGHKYLLTDVLKGQLGFDGVVLGDWSGHGFIPGCTALDCPDALLAGLDVYMIPDPEWKQLYYNLIDQVRGGIIPQARLDDAVCRMLRVKMRAGMFDKARPSRRPWANRADRLGSPEHRAVARRAVRESLVMLKNRGNLLPLAPNQRVLVAGDGAHNIGKQAGGWSVTWQGTGTTKEDFPGATTIFEGIAQVVNAAGGEAVLSGDGSFDQRPDVAIVVFGEDPYAEMQGDMANTLYKPGDDSDLALLRRLRAQEIPVVALFITGRPLWVNRELNASDAFVVIWQPGTEGGGVADVLFGDSEGRARHPMRGRLTFTWPRRPDQGPVNRGDEDYDPLFPYGFGLGYGDPDTLGQLPEEGVAVAATPDVLDIFYRRPMGPWQLEIEGRLNDRVAMTGSRADTSTVGVDAVDREVQEDARHVVWSGEGFGRLALASAKRVDLSDYLGANAALVFDVKVHKAPTRTLWLRLASASCCHADIDVTDEFFG

SEQ ID NO: 423 - DNA, 1338 bp, Unknown
  Obtained from environmental sample
atgaatcacgctgcacgccgccgtactttactgggcctgggcacggcacttgccggcgctacgctgctgccgcgcggcgctgccgccgccacggcacgcggacctttcccccagggcttcctgtggggcgcggccatcgccggccaccaagcggaaggcgacaacgtcgcgagcgacgcctggctgctggagaacattcagccgacggaattcaaggagccgtcgggcgccgccgtcgatcactaccgcctgtacgaccaggacatcgcgaccctcgcgtcgctgggcctgaataccttccgcttctcgatcgagtgggcgcgcgtggaacccgtcgaaggcatgttctcggtcgccgcgctggaacactatcgcgacgtgctgcagtcctgccgccggcatcgggtgaaagcgatggtcagcttcaaccacttcgtcacgcccgcgtggttcgcggcacggggcggctgggaaacggacgggtcggcgcagctgtacgcccgctactgcgacaaggttgcgcgccacctgggcgacctgatcgattacgcgacgacgttcaacgaaccgaatctgccgcgcctgttgttcggcatcccggggccgctggccggcatggccgacaacccgcgcatgaaggcgatgctcgcgaaggcggggcagctggcgggcaccggcaagtggtcgtcatggatcttcggcgacttcgcgcgcatcgaggcgggcctgctgcaggcgcacgcggccggctacgcggccatcaaggccgtgcgaccgcagctgccggtcggcttctcgatcgccatcgcggacgaccaggccatcgacggcggcgaggcgatggtcgcgcgcaagcgggcgatcgcttacgagccgtggtatcgggcgatcgccgaacacggcgacttcatcggcgtgcagacctatacgcgcgagctgatcggccctgacggcgtgcgcccgccgccaaaagacgccaccttcacgtcggcgcacatggagtattacccgcaggcgctggaggcgacgatccgctacacggcgcagcacgtgaagctgccgatctacgtgacggaaaacggcatctcgacggacgacgatacccagcgcatcgcgtacatccgcacggccgtgggaggtgttgcgaactgcctgaaagacgggattcccgtgaagagctatatccactggtcgctgctcgacaacttcgagtggatcttcggttacggcccgcactacggcctgatcggcgtcgaccgcgcgacgatgaaacgcaccgtcaagccgagcgcgcgcgtgctcgggaagatcgggcaggcgaacggcatcgcggcgtga

SEQ ID NO: 424 - protein, 445 aa, Unknown
  Obtained from environmental sample
  SIGNAL (1)...(29)
  DOMAIN (32)...(443): Glycosyl hydrolase family 1
  SITE (360)...(368): Glycosyl hydrolases family 1 active site. Prosite id = PS00572
MNHAARRRTLLGLGTALAGATLLPRGAAAATARGPFPQGFLWGAAIAGHQAEGDNVASDAWLLENIQPTEFKEPSGAAVDHYRLYDQDIATLASLGLNTFRFSIEWARVEPVEGMFSVAALEHYRDVLQSCRRHRVKAMVSFNHFVTPAWFAARGGWETDGSAQLYARYCDKVARHLGDLIDYATTFNEPNLPRLLFGIPGPLAGMADNPRMKAMLAKAGQLAGTGKWSSWIFGDFARIEAGLLQAHAAGYAAIKAVRPQLPVGFSIAIADDQAIDGGEAMVARKRAIAYEPWYRAIAEHGDFIGVQTYTRELIGPDGVRPPPKDATFTSAHMEYYPQALEATIRYTAQHVKLPIYVTENGISTDDDTQRIAYIRTAVGGVANCLKDGIPVKSYIHWSLLDNFEWIFGYGPHYGLIGVDRATMKRTVKPSARVLGKIGQANGIAA

SEQ ID NO: 425 - DNA, 1704 bp, Unknown
  Obtained from environmental sample
atggatttgcaggccaaaccgttttatctcgatacccgacaagaacaatgggtccatgcgacccgtgatgcgatgactttggaggagaagatcgggcagttgttctgcccgattggcatcacgtatgatgagagcgagcttgcaaccttgcttggtacggtgcccattggcggaatcatgtttcgtccaggtccggccgcccaagtgcaggcagctcaccgattcctgcaagagcggagtaagacacccctacttttggctgcgaacctagaatcgggagggattgggacagcttccgaaggtacgctgtttgggacccaaatgcaggtagcagctaccggtcaggtggccatggccgaaacgttgggacgcattgctggacgcgagggaagagccgtgggtttgaactgggcttttgcaccagtaattgacatcgattggaatttccgcaacccgataacaaacacacgcacctatggctcagatcccgacacggtgcgcaaaatgggaagtgcctatatgaaggcgcttcatgaagaaggcttggccgtgtcaatcaaacattttcctggtgacggcgtggacgagcgagaccagcatttgctaccgtcggtcaatgatctatcaccagacgcctggcacgcatcgtttggagccatctatcgagctctcattgaccaaggtgctcagactgtcatgatcggtcatattctgcttccgaaggtgcagcagtttttgcgaccagagatgcgagacgaggatgtaatgccagcgaccttggcccccgagctcctgcaggaccttcttcgtgaggaactagggtttaacggcatgatcgtgaccgacgcaacaccaatggctggttttatgcaaatgatgccacgttctcaggctgttcctcttagcatcgctgccggatgcgatatgtttttgttcaatcagaacttggaggaagattaccggtttatgatggacggcattgccgatggtttgctgaccgaagaaagggtagatgcggctgttacgaggatcttggccctgaaggcggccctcggactgccagagcaaaaggaaaccggaacgttggtcccgggacccgaagccttggatgtaatcggctgcgaggagcatgagcgctgggcagaggaatgtgctgaccaaagcgtgacattggttaaagatacccaggatctcctgccgttatcaccaaaaaggcacaggcgcattctcctttacgttctcggcgatgccgatgttcctggtgcccattcaggcggtacgagtcgacatcctcagttcatcgagttaatggagaaggcgggttttaaaataacggttttcgatccagcagaaggactcactttccggcgcaaatctactgctgacattgtgggcgagtacgacgttgccatttacttcgctaatattggcacgtacagcaaccaaaccgtgattcgagtaaactgggctccaccgatgggcgtggatgtacctcggttcattcatgaactgccgactatgttcatttccgttagtggtccgtaccatttgcaggatgtaccacggatcaagaccttcatcaatggctatacgccaagcccgcaggtagtgacggcggtagtggacaagatcctcggtcgcagtgagttcaaaggtacgagtccagtagatccctactgcggtctctgggacacgtacctatag

SEQ ID NO: 426 - protein, 567 aa, Unknown
  Obtained from environmental sample
  DOMAIN (74)...(312): Glycosyl hydrolase family 3 N terminal domain
  SITE (488)...(491): N-glycosylation site. Prosite id = PS00001
MDLQAKPFYLDTRQEQWVHATRDAMTLEEKIGQLFCPIGITYDESELATLLGTVPIGGIMFRPGPAAQVQAAHRFLQERSKTPLLLAANLESGGIGTASEGTLFGTQMQVAATGQVAMAETLGRIAGREGRAVGLNWAFAPVIDIDWNFRNPITNTRTYGSDPDTVRKMGSAYMKALHEEGLAVSIKHFPGDGVDERDQHLLPSVNDLSPDAWHASFGAIYRALIDQGAQTVMIGHILLPKVQQFLRPEMRDEDVMPATLAPELLQDLLREELGFNGMIVTDATPMAGFMQMMPRSQAVPLSIAAGCDMFLFNQNLEEDYRFMMDGIADGLLTEERVDAAVTRILALKAALGLPEQKETGTLVPGPEALDVIGCEEHERWAEECADQSVTLVKDTQDLLPLSPKRHRRILLYVLGDADVPGAHSGGTSRHPQFIELMEKAGFKITVFDPAEGLTFRRKSTADIVGEYDVAIYFANIGTYSNQTVIRVNWAPPMGVDVPRFIHELPTMFISVSGPYHLQDVPRIKTFINGYTPSPQVVTAVVDKILGRSEFKGTSPVDPYCGLWDTYL

SEQ ID NO: 427 - DNA, 954 bp, Thermotoga maritima
  misc_feature: Thermotoga maritima MSB8 DNA
atgggtgttgatccttttgaaaggaacaaaatattgggaagaggcattaatataggaaatgcgcttgaagcaccaaatgagggagactggggagtggtgataaaagatgagttcttcgacattataaaagaagccggtttctctcatgttcgaattccaataagatggagtacgcacgcttacgcgtttcctccttataaaatcatggatcgcttcttcaaaagagtggatgaagtgataaacggagccctgaaaagaggactggctgttgttataaatattcatcactacgaggagttaatgaatgatccagaagaacacaaggaaagatttcttgctctttggaaacaaattgctgatcgttataaagactatcccgaaactctattttttgaaattctgaatgaacctcacggaaatcttactccggaaaaatggaatgaactgcttgaggaagctctaaaagttataagatcaattgacaaaaagcacactataattataggcacagctgaatgggggggtatatctgcccttgaaaaactgtctgtcccaaaatgggaaaaaaattctatagttacaattcactactacaatcctttcgaatttacccatcaaggagctgagtgggtggaaggatctgagaaatggttgggaagaaagtggggatctccagatgatcagaaacatttgatagaagaattcaattttatagaagaatggtcaaaaaagaacaaaagaccaatttacataggtgagtttggtgcctacagaaaagctgaccttgaatcaagaataaaatggacctcctttgtcgttcgcgaaatggagaaaaggagatggagctgggcatactgggaattttgttccggttttggtgtttatgatactctgagaaaaacctggaataaagatcttttagaagctttaataggaggagatagcattgaataa

SEQ ID NO: 428 - protein, 317 aa, Thermotoga maritima [sequence omitted]

SEQ ID NO: 429 - DNA, 894 bp, Thermotoga maritima
  misc_feature: Thermotoga maritima MSB8 DNA
atggctcagtgggactttaattttgttagaatccctatgtgtcatcttctctggtcagaccggggcaacccatttattatcagagaagatttttttgagaaaatcgatcgtgtaattttctggggagagaaatatggaatacatatatgtatttctcttcacagggcacctggctattctgttaacaaggaagtagaagagaaaaccaatctgtggaaagatgaaacagctcaagaagcgttcattcatcactggtcttttatcgcacgtcgttacaaaggaatttcttccacacacctgagttttaacttaataaatgagcctccatttcctgatccacaaatcatgagtgttgaagatcacaactctcttatcaagagaactattacagaaattcgaaaaatagatcccgaaagattaattataatagatggattaggctatgggaatattccagtggatgatttaacaattgagaatacagtgcaatcatgcagagggtacattcccttcagtgttactcattacaaagcggaatgggtggatagtaaggactttcctgttcctgagtggccaaatggatggcattttggggaatactggaacagagaaaagttattggaacattatttaacgtggataaaactcagacaaaaaggaatagaagtattctgtggagaaatgggagcttacaacaaaacacctcacgatgtggttttaaaatggcttgaagatcttttagaaatttttaaaactttgaacatagggtttgccttatggaattttagaggtccttttggtattttagattcggaaaggaaagacgttgaatacgaagaatggtatggacataaactggataggaaaatgttggaactattgagaaaatattag

SEQ ID NO: 430 - protein, 297 aa, Thermotoga maritima
  DOMAIN (1)...(297): Thermotoga maritima MSB8 protein
  DOMAIN (1)...(271): Cellulase (glycosyl hydrolase family 5)
MAQWDFNFVRIPMCHLLWSDRGNPFIIREDFFEKIDRVIFWGEKYGIHICISLHRAPGYSVNKEVEEKTNLWKDETAQEAFIHHWSFIARRYKGISSTHLSFNLINEPPFPDPQIMSVEDHNSLIKRTITEIRKIDPERLIIIDGLGYGNIPVDDLTIENTVQSCRGYIPFSVTHYKAEWVDSKDFPVPEWPNGWHFGEYWNREKLLEHYLTWIKLRQKGIEVFCGEMGAYNKTPHDVVLKWLEDLLEIFKTLNIGFALWNFRGPFGILDSERKDVEYEEWYGHKLDRKMLELLRKY

SEQ ID NO: 431 - DNA, 1230 bp, Unknown
  Obtained from environmental sample
gtgaccggcaccgtgccgaccggcttcctgtggggcgtggcgacggcgggccaccagaacgagggagacaacgtcaccagcgacacgtggttcctggagcacgtgcggcccacggtgttccgggagccgtccggcgcggcgtgcggatcgttccggctgtgggagaccgacctcgacctcgtcgcggcgatggggctgaccgcgtaccgcttctccgtcgagtgggcgcgggtcgagccggaggagggccggttctccgacgctgcgctggcgcactacgcggcggtggtcgacggctgcctggcccgcgggctggcgccgatcgtgacgctgaaccacttcaccgcgccgcactggttcgcctgccggggcggctggctggacccggacgcgccgcagctgttcgcgcgctacacggaccgggtgatggcccggttcggcgcccgcatgtcccacgtcgtcacgctgaacgagccgaacctgtcccgggtgctggcctggtccgggctgcccgacgtcgtcgccgagctggagcgcgcgacgctggcagcggcgtccgccgcggcgggcgtgccgcgctaccgggtcggcaacgtcgtgctgccggaggagtacgacgcgctggccgacggcatggcggcggcgcacgtcgcagcgaaggcggtcgtcaagcggcaccggccggacctgccggtcgggctgtcgctcgccgtcgtcgacgaccaggtcgcgggcgacgacgcggcgatacgagatcgcaagcggcgcgacgcctacgggcgctggctggacctcgtccgcgccgacgacttcgtcggggtgcagaactacgagcgcgtcgtgtacgacgcgcgcggccgggtcgagcgccccggcccgcgcaaccagatgggctcgctgatcgagccgggctcgctcgccggggcggtgcggtacgtgcacgaggcgaccggccgtcccgtgctggtgaccgagcacggcatcgccaccgccgacgacacgcagcgggtggcgttcctcgcgccggcgatcgaggggctgctggccgccgccgccgacggcgtgcccgtgctcgggtactgccactggacgctgctggacaacttcgagtggatcttcggctacgagcaccagttgggcttgcacgaggtcgaccgcgtcaccctcgcgcgcaccccgaagcccagcgcccacgagtacgcccgcctcgtcgccacccaccacccctga

SEQ ID NO: 432 - protein, 409 aa, Unknown
  Obtained from environmental sample
  DOMAIN (1)...(409): Glycosyl hydrolase family 1
  SITE (24)...(27): N-glycosylation site. Prosite id = PS00001
  SITE (162)...(165): N-glycosylation site. Prosite id = PS00001
MTGTVPTGFLWGVATAGHQNEGDNVTSDTWFLEHVRPTVFREPSGAACGSFRLWETDLDLVAAMGLTAYRFSVEWARVEPEEGRFSDAALAHYAAVVDGCLARGLAPIVTLNHFTAPHWFACRGGWLDPDAPQLFARYTDRVMARFGARMSHVVTLNEPNLSRVLAWSGLPDVVAELERATLAAASAAAGVPRYRVGNVVLPEEYDALADGMAAAHVAAKAVVKRHRPDLPVGLSLAVVDDQVAGDDAAIRDRKRRDAYGRWLDLVRADDFVGVQNYERVVYDARGRVERPGPRNQMGSLIEPGSLAGAVRYVHEATGRPVLVTEHGIATADDTQRVAFLAPAIEGLLAAAADGVPVLGYCHWTLLDNFEWIFGYEHQLGLHEVDRVTLARTPKPSAHEYARLVATHHP

SEQ ID NO: 433 - DNA, 1212 bp, Unknown
  Obtained from environmental sample
atgtcttcgaatcagtatgattacatcatagttggagctggtctttctggcggaattttagctagattgttagcagagagtttagacaaaaggatcttaatcgtagacagaagaaatcacatttcaggtaacatatatgattttgttgactcatgtggtattaaggttcaaaagtatggaccacatgtattccatacaaattctgacgatgtttataattttatttctaaatattgtgagcctgtaaaatatcgtaccaaatgtgaagctgtcatagatggaattagcacaccatctccttttaattttaaaactatcgatcaattttacgataaagaaaaagcacaaatcttaaagaataagttgcagtcttactatccaaatgtgcattcagtgactgttgttgatatgttgaattcatctgattcagatatcaaaagtcacgctcaatttttatttgataaagattacaaactatatacagcaaaacagtggaacttaagcccagatgaaattgatccttctgtattaaaaagagttccaattgaactgtcttatgatgatacttattttcatgataaatatgaattcatgcctaaggatggatttctcgaattctataattgtttagttagccataaaaacattgaaattaagactaacatagaagcgcttgaacatatatcatttgatgaagctgaacattctgttatgtgggatgataggttagtaaacttgatttatactggtgctattgatgagttgtttcagtgtaaatttggagttcttccttatagatccttgtgttttaaatacgctcatccgaagacatgctcttatcaaaatgtgtctattgttgcttaccctcaggttgaaggctacacacgtataactgagtacactaagatgccttaccaggattgtaatggaattacaacaattgcttatgagtatcccattgagtatcaagctaattttgaaaatgataataaatcatcagatgtaactgagccatactaccctgttttaacagaaaatagtcaaaagatatttagcctctataaaagttatgccgatagatttaaaaatttaaccttatgtgggcgattggctgacttcaaatactacaatatggatcaagttgtattaagagcttttgatgtatacgaatcattaaggaaaaaagaaaatgttgcaaaagtgggaatttaa

SEQ ID NO: 434 - protein, 403 aa, Unknown
  Obtained from environmental sample
  DOMAIN (155)...(375): UDP-galactopyranose mutase
  SITE (141)...(144): N-glycosylation site. Prosite id = PS00001
  SITE (210)...(216): Immunoglobulins and major histocompatibility complex proteins signature. Prosite id = PS00290
  SITE (286)...(289): N-glycosylation site. Prosite id = PS00001
  SITE (335)...(338): N-glycosylation site. Prosite id = PS00001
  SITE (368)...(371): N-glycosylation site. Prosite id = PS00001
MSSNQYDYIIVGAGLSGGILARLLAESLDKRILIVDRRNHISGNIYDFVDSCGIKVQKYGPHVFHTNSDDVYNFISKYCEPVKYRTKCEAVIDGISTPSPFNFKTIDQFYDKEKAQILKNKLQSYYPNVHSVTVVDMLNSSDSDIKSHAQFLFDKDYKLYTAKQWNLSPDEIDPSVLKRVPIELSYDDTYFHDKYEFMPKDGFLEFYNCLVSHKNIEIKTNIEALEHISFDEAEHSVMWDDRLVNLIYTGAIDELFQCKFGVLPYRSLCFKYAHPKTCSYQNVSIVAYPQVEGYTRITEYTKMPYQDCNGITTIAYEYPIEYQANFENDNKSSDVTEPYYPVLTENSQKIFSLYKSYADRFKNLTLCGRLADFKYYNMDQVVLRAFDVYESLRKKENVAKVGI

SEQ ID NO: 435 - DNA, 1200 bp, Unknown
  Obtained from environmental sample
atgttttccgtcaatcgccatgattttgggccgaacttcactttcggcgtcgccaccgccagctatcagatcgagggcaacgccaccggcgagggccgcggttcctcgatctgggatacgttttcggccactcccggtaacgtcgagggcggcgacaccggcgccgttgccgatgaccattataaccgctgggaggaagacctcgacctcatccgcgacggcggctttgacgcctaccgcttctcggtagcgtggccgcggctgctgcccgagggtatcggcgccatcaaccaggccggcatcgacttctacgaccgcctgatcgacgggatgctggcgcgtggcatcaagccattcatgacgctgtatcattgggatctgccgtcggcgctgcaggacaagggcggctggatgaaccgcgatatcgccggctggctcggcgaatacgctgccctctgcggcaagcatttcggtgatcgggtcgccgccaccgccaccatcaacgagccgtggtgcgtggccttcctcagccatttcctcggcattcatgcccccggcctgcgcgacatgcgcgccgcggcccgcgccatgcaccatgtgctttatgcccacggccacgccgtcgccgcgctgcgcgccgagggcgtcaagaacatcggcatcgtcaccaatctgcagaagtgcgagccggtatcggggagcgacgccgaccgcgaggcgaccgacctcttcgacggcatcttcaacggctggtatctgggcggcctctacaaggggcagtacccggccaacgtagtgaaaatgttcgaaaaatacctgcccgccggcttcgagcgcgacatggacaaggtctcgacgccgctcgactgggccggcgtcaactattattcgcgcacgctcgttgccgccgatccgagcggccccaccggcttcaagaccgtcgagggcaagctggagaagaccgatatcggctgggagatctatccccagggcctcaccgacctgctggtccgggtgtcgcgcgactacaccaaggtgccgatctacgtcaccgagaacggcatggcggaagtcgacggcgagacggatccgcgccgcgtcacctattatgaagatcacctcaaggcgctgctcgccgcccgcgccgccggcgtcgacgtgcgcggctatttcgcctggtcgctgatggacaatttctag

SEQ ID NO: 436 - protein, 399 aa, Unknown
  Obtained from environmental sample
  DOMAIN (5)...(399): Glycosyl hydrolase family 1
  SITE (12)...(15): N-glycosylation site. Prosite id = PS00001
  SITE (27)...(30): N-glycosylation site. Prosite id = PS00001
  SITE (353)...(361): Glycosyl hydrolases family 1 active site. Prosite id = PS00572
MFSVNRHDFGPNFTFGVATASYQIEGNATGEGRGSSIWDTFSATPGNVEGGDTGAVADDHYNRWEEDLDLIRDGGFDAYRFSVAWPRLLPEGIGAINQAGIDFYDRLIDGMLARGIKPFMTLYHWDLPSALQDKGGWMNRDIAGWLGEYAALCGKHFGDRVAATATINEPWCVAFLSHFLGIHAPGLRDMRAAARAMHHVLYAHGHAVAALRAEGVKNIGIVTNLQKCEPVSGSDADREATDLFDGIFNGWYLGGLYKGQYPANVVKMFEKYLPAGFERDMDKVSTPLDWAGVNYYSRTLVAADPSGPTGFKTVEGKLEKTDIGWEIYPQGLTDLLVRVSRDYTKVPIYVTENGMAEVDGETDPRRVTYYEDHLKALLAARAAGVDVRGYFAWSLMDNF

SEQ ID NO: 437 - DNA, 1443 bp, Unknown
  Obtained from environmental sample
atgacgaccttcaacgtcagtgccgtggcaaccgccccggcccctactgcctccacgacccgacccgccgccgcatcggcaggttgcgcccccggtggactgcccaccgcggcggcccgccagttccccgccgacttcgtctgggcggtcgccaccagcgccttccagatcgaaggcgcggccgaccgggatggcaagggcccgtccatctgggacaccttctgccgccagcccggcgccattgccgacaacagccatggcgacatcgcctgcgaacactacgaccgctgggaagccgacctggacctgatccagagcctgggcgcccaggcctatcgcttctccatctcctggccgcgggtgcgtgccaccggcgacggcccgtggaatgaagccggcctggctttttacgagaaactggtggacggcatcaatgcgcgcggcatgaaggcctatgtgacgctcaatcactgggacctgccgcaagcgctgcaggacatcggcggctggggaaaccgcgccaccgtggaccgctttgttgaatatgccgaagccatcggccgccggatcggccacaaggtggcctccatcgcgacgcacaacgagccttgggtggtggcgcagctgggccatgaggtgggcatcttcgcgcctggcctgaaggaccgccgcctcgcggcccaggtctcgcaccacctgctgctcagccacggccgcgccgtgcggcgcctgcgtgccctggagctgccggcctcgctgggcatcgtgctcaacctctcgccgatctatcccgccacggacaccccggaagaccgggccaaggcccgcctcgaagacggcaagctgcgccggtggtacatggacccgctgttcaagggccactatccgcaggatgtgctggatcacctgggcgatgacgcaccgcaggtgcaagacggcgacatggccgacattcagcagccgatcgatttcgtgggggtgaactactactcccgcggcatggccagcgccgacaacagcttcgattcaaagaccagcggcctgccgctgaccgccatgggctgggaggtctatccccagggcctgaccgacctgctggtctggctgcaccgcgactatcccgaagcgaagcggctgtacgtgaccgaaaacggcggcgccttccctgatgtcgtgggcgccgacggccgcgtgcacgatgccgaccgcaccagttatctggacacccacatcgccgccgtcggagacgccatcgcccagggcgtgccgatgggcggctacatggtgtggagcctgctcgacaacttcgaatgggcctccggctacgagaagcgcttcggcatcgtccacgtggactacgccacgcagaagcgcacccccaaggacagcgccctggccttccgcgatttcgtgcgcggactcaagccggcggcccaggactga

SEQ ID NO: 438 - protein, 480 aa, Unknown
  Obtained from environmental sample
  SIGNAL (1)...(25)
  DOMAIN (38)...(476): Glycosyl hydrolase family 1
  SITE (5)...(8): N-glycosylation site. Prosite id = PS00001
  SITE (46)...(60): Glycosyl hydrolases family 1 N-terminal signature. Prosite id = PS00653
  SITE (261)...(264): N-glycosylation site. Prosite id = PS00001
MTTFNVSAVATAPAPTASTTRPAAASAGCAPGGLPTAAARQFPADFVWAVATSAFQIEGAADRDGKGPSIWDTFCRQPGAIADNSHGDIACEHYDRWEADLDLIQSLGAQAYRFSISWPRVRATGDGPWNEAGLAFYEKLVDGINARGMKAYVTLNHWDLPQALQDIGGWGNRATVDRFVEYAEAIGRRIGHKVASIATHNEPWVVAQLGHEVGIFAPGLKDRRLAAQVSHHLLLSHGRAVRRLRALELPASLGIVLNLSPIYPATDTPEDRAKARLEDGKLRRWYMDPLFKGHYPQDVLDHLGDDAPQVQDGDMADIQQPIDFVGVNYYSRGMASADNSFDSKTSGLPLTAMGWEVYPQGLTDLLVWLHRDYPEAKRLYVTENGGAFPDVVGADGRVHDADRTSYLDTHIAAVGDAIAQGVPMGGYMVWSLLDNFEWASGYEKRFGIVHVDYATQKRTPKDSALAFRDFVRGLKPAAQD

SEQ ID NO: 439 - DNA, 1254 bp, Unknown
  Obtained from environmental sample
atgactcacaaaaccaagtcgattgcatcgctttccctcatccttatgctgctggctgtgccgttggcgctggcgtcgtcggtaccggtggccgaaccggaagacgttggcttttccgccgagcggctgcaaaggatacacgagttggtcgaccgccatctggaggcggggagtttcgccggcgctgtcactctggtggcgcggcacggccatattgcgcatttcgaggcccacggcctgatggacctcgaaacgagaaagccgatggcgaaggatgccattttccgcatcatgtcgatgacgaagcctgtggtcggcgtcgccgtcctgatgctgatggaagaaggaaaagttcgcctcaacgaccccttgtcgagattcatacccgagcttaaagacctgaaggtcgctgtcgttcagggcgagagtgcggccggagctgaatctcgcttttacacaatcccggcggaccgtgaaattacggttcgggatctgctgactcacacatccggcttcgtcagcggcggcaccagcaatcgcgaagcccagcgcgccagcggcggcattcgaccgaacgacacgctggccacgtacctgccgcggctggcagcggctccgctcgagttccagccgggaacgcgctgggcctatagcgcggcggcgggattcgacgcgctggcacgcgtggtagaggtcgcctccgggcagaccttcgacgaatttgcgcggcaacgcttattcgaaccgcttggaatgaaggacaccttcttctacgccgccgatccgccggtggaccgctttgcaacgctgtatcgacggactgaaagcggattggagaagcagcaagatccgaatttcatgaacggcacatacctttccgggggaggaggactgttcagcaccgccgaagactatcttcagttcgggcagatgctggtcaatggcggcgagttgaacggaacacggctgctcagtccgaggaccgtcgagttgatgcggtccgtctacgctcccgacagcctgccgggacggccagcgggcgaaggctatggcctgagcgtccgcgtgatcaacgattcgattcaaagagggaccatgctctccgacggcgccttcggttggagcggcgcctttgggacccacttctgggtcgatccgaaggagaaggtcgtcggtatttttatgacccaaacctcgacgccggcaatccggccggatctggagaatgccgtgatgcaggccatcatggagtag

SEQ ID NO: 440 - protein, 417 aa, Unknown
  Obtained from environmental sample
  SIGNAL (1)...(25)
  DOMAIN (46)...(417): Beta-lactamase
  SITE (194)...(197): N-glycosylation site. Prosite id = PS00001
  SITE (292)...(295): N-glycosylation site. Prosite id = PS00001
  SITE (323)...(326): N-glycosylation site. Prosite id = PS00001
  SITE (363)...(366): N-glycosylation site. Prosite id = PS00001
MTHKTKSIASLSLILMLLAVPLALASSVPVAEPEDVGFSAERLQRIHELVDRHLEAGSFAGAVTLVARHGHIAHFEAHGLMDLETRKPMAKDAIFRIMSMTKPVVGVAVLMLMEEGKVRLNDPLSRFIPELKDLKVAVVQGESAAGAESRFYTIPADREITVRDLLTHTSGFVSGGTSNREAQRASGGIRPNDTLATYLPRLAAAPLEFQPGTRWAYSAAAGFDALARVVEVASGQTFDEFARQRLFEPLGMKDTFFYAADPPVDRFATLYRRTESGLEKQQDPNFMNGTYLSGGGGLFSTAEDYLQFGQMLVNGGELNGTRLLSPRTVELMRSVYAPDSLPGRPAGEGYGLSVRVINDSIQRGTMLSDGAFGWSGAFGTHFWVDPKEKVVGIFMTQTSTPAIRPDLENAVMQAIME

SEQ ID NO: 441 - DNA, 2025 bp, Thermotoga maritima
  misc_feature: Thermotoga maritima MSB8 DNA
gtggactacaggatgtgctggctggagtacagaggtttaccagctgatgtcgccggaaaactcaaagactggttttcaagtgtttccattctggaacccggttcttcagttttgaaagacgagatcagaagattttctgaaagatcgattggcatcactcccagattttattccagacccttgaagaaagaaaaatacatcatggtgggacgtttggaatcccttcccatcaagcttgatgtgaatcttggtgaggaaggtttcatgctgagaacgattgagtggaatggttcgaaaattctgcttgtaactggcgaaacaaagaaggcgcttgtttacgggatttttgatttgatgaagagaataagacttggtgaagatatcgagaagatgaacgtcctggcgaagccgaaagcgaaatttcgtatgcttaaccactgggacaacctcgatggaacgatcgagagaggatacgcagggaactccatttttttcaaagacaacagaattatcataaatcagagaacgaaagactacgccagacttttagcctcaataggtataaacggtgttgttataaacaacgtgaacgtcaaaaagcgagaagtttacttgatagactctatctaccttaaaaaattgaaaaagttggctgatatcttcagagagtatggaattaagatctatctaagtataaacttcgcttctcctgtttatctgggagggctggatacggccgatcccctcgacgaaagagtggcgcgctggtggagagaaaaagcgaggggaatatacgattatattccagattttggaggatttcttgtcaaagccgattctgagttcaatcctggaccgcacatgtttggaagaacgcatgcagaaggggcaaacatgcttgcaagggctctggcaccgttcggtggagtagtaatatggagagcttttgtttacaactgcctccaggactggagagattacaagacggacagagcaaaggcggcttatgacaatttcaagcctcttgatgggcagttcgacgacaacgtgatcattcaaataaagtatggtcctatggattttcaggtgagagaacccgtcaatccgcttttcggaggaatggagaagacaaatcaaattcttgagcttcaaatcacgcaggaatacacaggtcagcagattcatctgtgttttttaggaaccctctggaaggagatactggaattcgacacgtttgcgaagggtgagggttcttacgtgaagagaatcgtggatggaactctctttgaccgtgaaaacaacggttttgccggagtatcaaacgttggtgacagtgtgaactggacgggccacgatctcgctcaggcgaatttatacgcgttcggaagacttgcgtggaatcccgatgaagaaatcgaaaggatagttgaagaatggataaaactcactttcggcgatgacgagaaggttctggaaaatgtttcatacatgttgatgaaatcccacaggacgtatgagaaatacaccactccgttcgggttgggatggatggtgaatcctggtcaccactacggtccaaatccggagggatacgaatattcgaaatggggtacttaccacagagccaactgggaagcgatcggtgtcgatagaacttccagaggcactggttacacccttcaataccattcaccgtggaaagagatatacgatgatatcaacacgtgtcccgaggatcttcttcttttcttccacagggtacgatacgatcatcgtttgaaatccggaaagacactccttcagacgatgtacgatctccactttgaaggggtggaggaagtagaagaattcataaagaaatgggaggaactgaaagacagggtatcaccagatatttttgagagagtgaaagagcgtcttcatatgcaactcgaacacgcgaaggagtggcgtgatgtaatcaacacatacttttacaggagaacgggtatccctgatgagaagggaagaaagatatatccgtga

SEQ ID NO: 442 - protein, 674 aa, Thermotoga maritima
  DOMAIN (1)...(674): Thermotoga maritima MSB8 protein
  DOMAIN (6)...(118): Glycosyl hydrolase family 67 N-terminus
  DOMAIN (119)...(448): Glycosyl hydrolase family 67 middle domain
  DOMAIN (449)...(673): Glycosyl hydrolase family 67 C-terminus
  SITE (97)...(100): N-glycosylation site. Prosite id = PS00001
  SITE (453)...(456): N-glycosylation site. Prosite id = PS00001
  SITE (500)...(503): N-glycosylation site. Prosite id = PS00001
MDYRMCWLEYRGLPADVAGKLKDWFSSVSILEPGSSVLKDEIRRFSERSIGITPRFYSRPLKKEKYIMVGRLESLPIKLDVNLGEEGFMLRTIEWNGSKILLVTGETKKALVYGIFDLMKRIRLGEDIEKMNVLAKPKAKFRMLNHWDNLDGTIERGYAGNSIFFKDNRIIINQRTKDYARLLASIGINGVVINNVNVKKREVYLIDSIYLKKLKKLADIFREYGIKIYLSINFASPVYLGGLDTADPLDERVARWWREKARGIYDYIPDFGGFLVKADSEFNPGPHMFGRTHAEGANMLARALAPFGGVVIWRAFVYNCLQDWRDYKTDRAKAAYDNFKPLDGQFDDNVIIQIKYGPMDFQVREPVNPLFGGMEKTNQILELQITQEYTGQQIHLCFLGTLWKEILEFDTFAKGEGSYVKRIVDGTLFDRENNGFAGVSNVGDSVNWTGHDLAQANLYAFGRLAWNPDEEIERIVEEWIKLTFGDDEKVLENVSYMLMKSHRTYEKYTTPFGLGWMVNPGHHYGPNPEGYEYSKWGTYHRANWEAIGVDRTSRGTGYTLQYHSPWKEIYDDINTCPEDLLLFFHRVRYDHRLKSGKTLLQTMYDLHFEGVEEVEEFIKKWEELKDRVSPDIFERVKERLHMQLEHAKEWRDVINTYFYRRTGIPDEKGRKIYP

SEQ ID NO: 443 - DNA, 1077 bp, Unknown
  Obtained from environmental sample
atgaacttcagtctcaggaaggctgcagcggcgctggcttgcgtcgcgggcctgtatgcatcatcggcgggcgctcagacctgcctgaccaacaaccagaccggcaacaacggcgggtactactactcgttctggaaggacagcggcaacgtcaccttctgcctgcagtccggcgggcgatacacgtcccagtggagcaacgtcaacaactgggtgggcggcaagggctggaacccgggtgggcgacgcaccgtcacctattccggcacctacaaccccaatggcaattcgtacctgaccctgtacggctggaccacgaatccactggtcgagtactacatcgtcgacagctggggttcctggcgcccaccgggctcgggatacatgggcacggtcaccagcgatggcggcacctacgacatctatcgcacgcagcgtgtgaaccagccttccatcatcggcaccgcgacgttctaccaatactggagcgtgcggcaatcgaagcgcgtgggtggcaccatcacctcgggcaatcacttcgatgcctgggcctcgctgggcatgaacctcggcacgcacaactacatggtgatggccaccgagggctaccagagcagcggcagctcggacatcacggtgggcagcggcagttcgtcgtcgagcagcagctcgtccagcagtagcagctcgtcgtccagtagcagcagcagttcttcgtccagcagcagcggtggcggcggcaccaagagcttcaccgtgcgcgcacgcggcacggcgggtggcgagtccatcaccttgcgggtgaacaaccagaacgtgcagacctggacgctgggcaccagcatgcagaactacacggcgtccacctcgctgagcggcggcatcacggtggccttcaccaacgacggcggcaaccgcgacgtccaggtggattacatcatcgtgaatggccagacgcgccagtccgaggcgcagacctacaacaccggcctgtatgccaatggccgctgcggtggtggctctaacagcgagtggatgcactgcaacggcgccatcggctacggcaacacgccctag

SEQ ID NO: 444 - protein, 358 aa, Unknown
  Obtained from environmental sample
  SIGNAL (1)...(25)
  DOMAIN (35)...(213): Glycosyl hydrolases family 11
  SITE (2)...(5): N-glycosylation site. Prosite id = PS00001
  SITE (32)...(35): N-glycosylation site. Prosite id = PS00001
  SITE (50)...(53): N-glycosylation site. Prosite id = PS00001
  SITE (109)...(119): Glycosyl hydrolases family 11 active site signature 1. Prosite id = PS00776
  SITE (201)...(212): Glycosyl hydrolases family 11 active site signature 2. Prosite id = PS00777
  SITE (288)...(291): N-glycosylation site. Prosite id = PS00001
MNFSLRKAAAALACVAGLYASSAGAQTCLTNNQTGNNGGYYYSFWKDSGNVTFCLQSGGRYTSQWSNVNNWVGGKGWNPGGRRTVTYSGTYNPNGNSYLTLYGWTTNPLVEYYIVDSWGSWRPPGSGYMGTVTSDGGTYDIYRTQRVNQPSIIGTATFYQYWSVRQSKRVGGTITSGNHFDAWASLGMNLGTHNYMVMATEGYQSSGSSDITVGSGSSSSSSSSSSSSSSSSSSSSSSSSSSSGGGGTKSFTVRARGTAGGESITLRVNNQNVQTWTLGTSMQNYTASTSLSGGITVAFTNDGGNRDVQVDYIIVNGQTRQSEAQTYNTGLYANGRCGGGSNSEWMHCNGAIGYGNTP

SEQ ID NO: 445 - DNA, 1605 bp, Agaricus bisporus
  misc_feature: Agaricus bisporus ATCC 62489 DNA
atgtctgctgcactgtcttatcgcatttacaagaatgctctcctcttcactgccttcttgactgccgctcgggcacagcaagttggcacctcaaccgctgaggttcacccgtctttgacctggtcgcaatgtaccagcggtggaagctgcaccacgcagagcggctcggttgtcatcgatgccaactggcgatgggtccacaacgtcggtggctctaccaactgctacaccggtaacgaatgggacaccacgctttgccctgacgatgttacctgcgcgaccaactgcgctttggacggtgccacatacgaagctacctacggtgtaaccaccagcggtgatgagcttcgtctgaactttgttactactgcctcgcagaagaacattggatctcgtctgtacctgatggaggatgacaccacctaccagatattcgatctgctgaatcaggaattcaccttcgacgtggacgtctctaaccttccctgtggtttgaacggtgccctctactttgtcgctatggactctgacggtggcatggctcgcttccccgcaaacaaggccggagcccaatatggaaccggttactgtgactctcagtgcccccgggacctcaaattcatcgatggtgaggccaactgcgatggctgggttccttccacaaccgatgtaaactctggtattggtaaccacggttcctgctgcgcggaaatggatatctgggaggctaactcgatctcgaacgcggtcactcctcacccttgtgaaactccaacccagactatgtgcgaggaagatgcttgtggtggtacttacagcactgatcgctacggtggcacttgcgatcctgatggatgtgatttcaacccttaccgcatgggtaacaccacattcttcggtcctgacatgaccgtcgataccaactccgtcttcactgttgtgactcagttcatcaccgatgatggcacctccacgggtactctgagtgagatcaagcggttctacgtgcaggacggcgtcgtcatccccaactcggcctctaccatcagtggtgtgagtggtaactctattacctcagacttctgcactgcccagaagactgccttcggtgatgaggacgttttcgacgagcgcggagggttggcgggtcttggtgccggtctcgctgacggcatggtcctggtcatgagtctctgggatgaccactatgccgacatgctctggctcgacagcatctacccaacaaacgatacctccaccacccccggtgccgctcgtggtacctgtgacatctcatctggagtcccagctaccattgaagactccgacgcaagcgcctatgtcatctactcaaacattaaggttggtccgattggctctaccttctcgtcgggtacctccagttctagcactagctcgagcactacttccaagactacttccacatccaccaagaccacctctaccactaccaccacggctgctagcaccactggtgctgctcactacgcccagtgtggtggatctggatggactggtgccactgcttgtgccagcccctacacctgcaccgcgcagaatgcctactactctcagtgcctataa

SEQ ID NO: 446 - protein, 534 aa, Agaricus bisporus
  DOMAIN (1)...(534): Agaricus bisporus ATCC 62489 protein
  DOMAIN (27)...(464): Glycosyl hydrolase family 7
  DOMAIN (502)...(530): Fungal cellulose binding domain
  SITE (299)...(302): N-glycosylation site. Prosite id = PS00001
  SITE (422)...(425): N-glycosylation site. Prosite id = PS00001
MSAALSYRIYKNALLFTAFLTAARAQQVGTSTAEVHPSLTWSQCTSGGSCTTQSGSVVIDANWRWVHNVGGSTNCYTGNEWDTTLCPDDVTCATNCALDGATYEATYGVTTSGDELRLNFVTTASQKNIGSRLYLMEDDTTYQIFDLLNQEFTFDVDVSNLPCGLNGALYFVAMDSDGGMARFPANKAGAQYGTGYCDSQCPRDLKFIDGEANCDGWVPSTTDVNSGIGNHGSCCAEMDIWEANSISNAVTPHPCETPTQTMCEEDACGGTYSTDRYGGTCDPDGCDFNPYRMGNTTFFGPDMTVDTNSVFTVVTQFITDDGTSTGTLSEIKRFYVQDGVVIPNSASTISGVSGNSITSDFCTAQKTAFGDEDVFDERGGLAGLGAGLADGMVLVMSLWDDHYADMLWLDSIYPTNDTSTTPGAARGTCDISSGVPATIEDSDASAYVIYSNIKVGPIGSTFSSGTSSSSTSSSTTSKTTSTSTKTTSTTTTTAASTTGAAHYAQCGGSGWTGATACASPYTCTAQNAYYSQCL

SEQ ID NO: 447 - DNA, 1200 bp, Unknown
  Obtained from environmental sample
atgatcgttggattctcgtttatgctgctgcttcctttagggatgacgaatgcattggcaaaaacggaaccagcgtacgctaaaaagccgcgaatcagcgcattgcacgcccctcaattggatcagcgctacaaagattccttcactattggggcggccgttgaaccttatcagttgcaaaacgaaaaagacgtccaaatgctgaaacgccattttaacagcattgtcgctgagaacgttatgaaaccgatcaacatccaacccgaagaaggaaagttcaattttgctgaggcggatcaaatcgtccgatttgctaaaaaacatcatatggatattcgtttccatacactcgtttggcacagccaagtacctcaatggttctttcttgacaaggaaggcaagccgatggtcaatgaaacggatccggcaaagcgcgaacaaaataaacagctgttactgaaacggctcgaaatccatattaaaacgattgtcgaacggtataaagacgacatcaaatattgggacgtcgtgaacgaggtagtcggggatgatggaaaattgcgcaattccccgtggtatcaaatcgccggcatcgattatatcaaggtagcattccaaacggcgagaacatatggcggcaacaagattaaactgtacatcaacgattacaataccgaagtggaaccgaagcgaagcgctctttataacttagtgaaacaattaaaagaagaaggcgttcccattgacgggattggccaccagtcccacatccaaattggctggccttctgaagaagaaatcgaaaaaacgatcaacatgtttgccgatctagggttagacaatcaaattacggagctggatgtgagcatgtacggctggccgccgcgcgcctacccgtcgtatgacgccattccggaacaaaagtttttggaccaagcggctcgctatgaccgattgtttaagctgtacgaaaaacttggcgataaaatcagcaacgtcaccttctggggcatcgccgacaaccatacgtggctcgacagccgtgcggatgtgtactatgacgccaacgggaatgttgtggttgacccgaacgctccgtacgcaaaagtggaaaaagggaaaggaaaagatgcgccgtttctgttcgaccccgaataccacgtaaaacctgcgtattgggccattatcgatcataagtga

SEQ ID NO: 448 - protein, 399 aa, Unknown
  Obtained from environmental sample
  SIGNAL (1)...(20)
  DOMAIN (39)...(399): Glycosyl hydrolase family 10
  SITE (140)...(143): N-glycosylation site. Prosite id = PS00001
  SITE (282)...(292): Glycosyl hydrolases family 10 active site. Prosite id = PS00591
  SITE (337)...(340): N-glycosylation site. Prosite id = PS00001
  SITE (346)...(349): N-glycosylation site. Prosite id = PS00001
MIVGFSFMLLLPLGMTNALAKTEPAYAKKPRISALHAPQLDQRYKDSFTIGAAVEPYQLQNEKDVQMLKRHFNSIVAENVMKPINIQPEEGKFNFAEADQIVRFAKKHHMDIRFHTLVWHSQVPQWFFLDKEGKPMVNETDPAKREQNKQLLLKRLEIHIKTIVERYKDDIKYWDVVNEVVGDDGKLRNSPWYQIAGIDYIKVAFQTARTYGGNKIKLYINDYNTEVEPKRSALYNLVKQLKEEGVPIDGIGHQSHIQIGWPSEEEIEKTINMFADLGLDNQITELDVSMYGWPPRAYPSYDAIPEQKFLDQAARYDRLFKLYEKLGDKISNVTFWGIADNHTWLDSRADVYYDANGNVVVDPNAPYAKVEKGKGKDAPFLFDPEYHVKPAYWAIIDHK

SEQ ID NO: 449 - DNA, 1350 bp, Cochliobolus heterostrophus
  misc_feature: Cochliobolus heterostrophus ATCC 48331 DNA
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctttccccaaaccagagcccagcaataccaccgtcaacccatggattggcaaggaccgctatgttgtcgaaagctacggcaagaagcttgaccaaaccattgcttccttcctatcaaagaatgactccctcaacgcagcacgaacccgcactgtggctaagaagacatccaccttcgtatgggttacatcgcgcgctggacttagccagatccccgaagccattcaacaagcccgccgtcaacaaaagggccgaaagaggatgattgtcggccttgtcctttacaatctccccgaccgtgactgctctgctggagagtctgccggagagctcagctccgccaaagacggcctgaacatctacaagcacgaattcgtcgacaagtacgcacagctcgtatccgaggccaaggatctcgacttcgccattgttctcgagcccgactcgctcggcaacgctgtcaccaaccaaggtattcccttctgcgccaacgccacccccatctacgagcaaggtatcgcttacgccattgccaagctgcagttccccaatgtatccctatacatggatgctgctcatggaggctggcttggatgggccgacaacctgaaacccacagcccagatctttgccagagttgtcgaagcggctaagaagatcaacccagcggccaagatccgtggttactctaccaacgtatccaactacaaccctttcaacgccaaggtccgcgagaactacaccgaatggtctccatcgtgggatgaaagccactacgctacctctcttggagcggcaatggcagctgagggcatgccaaccaacttcatcatcgaccagggccgtgttgccctccccggtgctcgcaaggagtggggcgagtggtgcaacgtttcgccctctggctttggactgcgccctggagctgcaccaaacaacaccaacgtcgactcgattgtctggattaagcccggtggtgagagtgacggagcctgcggtctggctggtgcgcctgttgctggtgcttggttcgacgactacgttcagatgctcgtcaagaacgccgaccctcctcttgagcctacctactag

SEQ ID NO: 450 - protein, 449 aa, Cochliobolus heterostrophus
  DOMAIN (1)...(449): Cochliobolus heterostrophus ATCC 48331 protein
  SIGNAL (1)...(19)
  DOMAIN (1)...(86): Mating factor alpha precursor N-terminus
  DOMAIN (121)...(431): Glycosyl hydrolases family 6
  SITE (23)...(26): N-glycosylation site. Prosite id = PS00001
  SITE (57)...(60): N-glycosylation site. Prosite id = PS00001
  SITE (68)...(71): N-glycosylation site. Prosite id = PS00001
  SITE (96)...(99): N-glycosylation site. Prosite id = PS00001
  SITE (128)...(131): N-glycosylation site. Prosite id = PS00001
  SITE (231)...(240): Glycosyl hydrolases family 6 signature 2. Prosite id = PS00656
  SITE (274)...(277): N-glycosylation site. Prosite id = PS00001
  SITE (322)...(325): N-glycosylation site. Prosite id = PS00001
  SITE (337)...(340): N-glycosylation site. Prosite id = PS00001
  SITE (404)...(407): N-glycosylation site. Prosite id = PS00001
MRFPSIFTAVLFAASSALAAPVNTTTEDETAQIPAEAVIGYSDLEGDFDVAVLPFSNSTNNGLLFINTTIASIAAKEEGVSLEKREAFPKPEPSNTTVNPWIGKDRYVVESYGKKLDQTIASFLSKNDSLNAARTRTVAKKTSTFVWVTSRAGLSQIPEAIQQARRQQKGRKRMIVGLVLYNLPDRDCSAGESAGELSSAKDGLNIYKHEFVDKYAQLVSEAKDLDFAIVLEPDSLGNAVTNQGIPFCANATPIYEQGIAYAIAKLQFPNVSLYMDAAHGGWLGWADNLKPTAQIFARVVEAAKKINPAAKIRGYSTNVSNYNPFNAKVRENYTEWSPSWDESHYATSLGAAMAAEGMPTNFIIDQGRVALPGARKEWGEWCNVSPSGFGLRPGAAPNNTNVDSIVWIKPGGESDGACGLAGAPVAGAWFDDYVQMLVKNADPPLEPTY

SEQ ID NO: 451 - DNA, 1545 bp, Unknown
  Obtained from an environmental sample
atgtatcgcgtcatcgcaaccgcctcggctcttattgccactgctcgggctcaacaggtctgctctttgaccaccgagaccaagcctgccttgacctggtccaagtgtacatccagcggctgcagcgatgtcaagggctccgttggtattgatgccaactggcgatggactcaccagacttctggatctaccaactgttacaccggaaacaagtgggacacctccgtctgcactgatggtaagacctgcgccgagaagtgctgtcttgatggcgccgactatgctggcacctacggaatcacttccagcggcaaccagctcagtcttggattcgttacccagggtccctacagcaagaacatcggcagccgaacataccttatggagaacgagaacacctaccagatgttccagcttctgggtaacgagttcacctttgacgtcgatgtctctggtatcggctgcggtctgaacggtgcactctacttcgtcagcatggacgaggatggtggcaaggccaggtactccggaaacaaggccggagccaagtacggaactggctactgtgatgctcaatgccctcgtgatgtcaagttcatcaacggagttgccaactctgaaggctggaagccctctgacagtgatgctaacgctggtgttggcaatctgggcacctgctgccccgagatggatatctgggaggccaactccatctcaaccgccttcactcctcatccttgcaccaagctcacgcagcactcttgcactggcgactcttgtggtggaacctactctagtgaccgatatggcggtacttgcgatgccgatggttgtgacttcaacgcctaccgccagggcaacaagaccttctacggtcctggatccaacttcaacgttgataccaccaagaagatgactgtcgtcactcagttccacaagggcagcaacggacgtctttctgagatcacccgtctgtatgtccagaacggcaaggtcattgccaactccgagtccaagatttcaggcaaccccggtagctctctcacctctgacttctgctccaagcagaagagcgtctttggcgatatcgatgacttctctaagaagggtggctggaacggcatgagcgatgctctctccgcccccatggttcttgttatgtctctctggcacgaccaccactccaacatgctctggctcgactctacctacccaactgactctaccaaggtcggatcccagcgaggttcttgcgctaccacctctggcaagccctccgaccttgagcgagatgttcccaactccaaggtttccttctccaacatcaagttcggtcccatcggaagcacctacaagagcgacggcaccacccccaacccccctgccagcagcagcaccactggttcttccactcccaccaacccccctgccggcagcgtcgaccagtggggacagtgcggtggccagaactacagcggccccacgacctgcaagtctcccttcacctgcaagaagatcaacgacttctactcccagtgccagtaa

SEQ ID NO: 452 - protein, 514 aa, Unknown
  Obtained from an environmental sample
  DOMAIN (19)...(453): Glycosyl hydrolase family 7
  DOMAIN (482)...(510): Fungal cellulose binding domain
  SITE (291)...(294): N-glycosylation site. Prosite id = PS00001
  SITE (493)...(520): Cellulose-binding domain, fungal type. Prosite id = PS00562
  SITE (497)...(500): N-glycosylation site. Prosite id = PS00001
MYRVIATASALIATARAQQVCSLTTETKPALTWSKCTSSGCSDVKGSVGIDANWRWTHQTSGSTNCYTGNKWDTSVCTDGKTCAEKCCLDGADYAGTYGITSSGNQLSLGFVTQGPYSKNIGSRTYLMENENTYQMFQLLGNEFTFDVDVSGIGCGLNGALYFVSMDEDGGKARYSGNKAGAKYGTGYCDAQCPRDVKFINGVANSEGWKPSDSDANAGVGNLGTCCPEMDIWEANSISTAFTPHPCTKLTQHSCTGDSCGGTYSSDRYGGTCDADGCDFNAYRQGNKTFYGPGSNFNVDTTKKMTVVTQFHKGSNGRLSEITRLYVQNGKVIANSESKISGNPGSSLTSDFCSKQKSVFGDIDDFSKKGGWNGMSDALSAPMVLVMSLWHDHHSNMLWLDSTYPTDSTKVGSQRGSCATTSGKPSDLERDVPNSKVSFSNIKFGPIGSTYKSDGTTPNPPASSSTTGSSTPTNPPAGSVDQWGQCGGQNYSGPTTCKSPFTCKKINDFYSQCQ

SEQ ID NO: 453 - DNA, 2094 bp, Unknown
  Obtained from environmental sample
atggacagagaacaagcaaaacggaaggcggaagcgctggtcggtcaaatgacggtggaggaggccgcttcgcagctgcggttcgacgcgccggccatcgaaagactgaacataccggcatacaactggtggaacgagggactgcacggcctggccagaagcggtgtcgccacgagctttccgcaggcgatcgccatggccgccgctttcgacccggacatgatggaacgggtgggcgacgtcatcgcaacggaagcccgcgccagatacaatacctcatccgtccgcggcgaccgcggtatctacaagggcctgaccatctggtctccgaacgtgaacatcttccgcgatccgagatggggacgcggtcacgagacctacggagaggacccgtatctgacctcccgcctgggcgtcggcttcgtcaaaggcttgcagggcgagggggaaacgcggaaggtcgcggcatgcgcgaagcatttcgccgtccactccgggccggaggacctgaggcacaggttcaacgcgaccgtctccgagaaggacctgtacgagacgtatctgcccgcctttaaggcgctcgtccgggaagcggacgtcgagaccgtcatgggcgcctacaaccgcacgaacggggaaccgtgctgcggcagtaagaagctgttaagggatattttgagagacgaatggggcttccgcggccacgtcgtcagcgattgctgggccgtgaaggatttccatgagaaccataaggttacggagggaccggagcagtccgtcaagctcgctttggagaacggctgcgacgtcaattgcggctgcacgtttcagttcgtgatgagtgcgtacgcgaagggactcatctcggaggaaaccatccgtacatccgccgtcaggttgtttaccacaaggtatcttctgggcatgatggaggggagcgcgttcgaccgtatcggcatcgaagcgctggaagcgaaggagcatctgtccgttgccggggaagccgccgaaaagggatgcgtgctgctgaaaaacaacggcttgctcccgctcgatgccggaagcatcaaaaagatcggcgtcatcggaccgaacgcgaacagcagggcggcgctcatcggcaactaccacgggacctcctcccgctacgtcaccgttctcgagggcatacaggactatctcggcgatgacgtgcgtgtgctgtattccgagggctgtgatatcagtaacgacaaggtggagcccctggcgcaggacggcgacagactgtccgaagcgcaggccgtggcggacgcgtccgacgttgtcgtgctcgtggtcggactgaatgagaatctcgagggcgaagagggcgacgcgggcaaccagtacgtctccggcgacaagcaggacctcctgctgccggccccgcagagaaagctgatgcaggcggtctttgcctcaaagaagccgacggtcatcgtactgatggcgggcagctccatcgacctggaggaatacggcgaaaaggcggatgcgatcttgctgccctggtatccgggcgcgcgcggcggcaaaacggtcgcggacatcctcttcggcagggtctccccgtccggcaagcttccggtcaccttctaccgcaacgaagatctcgaaaagatccccgcgtttacggattacggtatgaaaaaccagacttaccgctatctcgattttgcacccctctatccgttcggctacggcctgacctacggcgactgtgccgtcgaaacggccgaagcttgtaaaacgggcgatacggtccgggtaagggctaccgtaaagaatctttccggcgtcgcgacgcaggaggtcatacaggtctatgcccaaaatgagggaagcgctacggcgccccgcaacccgcggcttgtcggcttcaaacggatatcctgcccgccgcagcggagcgtaacggaagaatgggagtttaaggcggagctgctggataccgtgggagcggacggacgcccggtcttcgaggagcacgccacactgtacgtttctttgggacaaccggacgcgctgacggaaaaactgacgggacacgccgccatacggatcggcatctga

SEQ ID NO: 454 - protein, 697 aa, Unknown
  Obtained from environmental sample
  DOMAIN (30)...(273): Glycosyl hydrolase family 3 N terminal domain
  DOMAIN (340)...(580): Glycosyl hydrolase family 3 C terminal domain
  SITE (92)...(95): N-glycosylation site. Prosite id = PS00001
  SITE (177)...(180): N-glycosylation site. Prosite id = PS00001
  SITE (211)...(214): N-glycosylation site. Prosite id = PS00001
  SITE (566)...(569): N-glycosylation site. Prosite id = PS00001
  SITE (612)...(615): N-glycosylation site. Prosite id = PS00001
MDREQAKRKAEALVGQMTVEEAASQLRFDAPAIERLNIPAYNWWNEGLHGLARSGVATSFPQAIAMAAAFDPDMMERVGDVIATEARARYNTSSVRGDRGIYKGLTIWSPNVNIFRDPRWGRGHETYGEDPYLTSRLGVGFVKGLQGEGETRKVAACAKHFAVHSGPEDLRHRFNATVSEKDLYETYLPAFKALVREADVETVMGAYNRTNGEPCCGSKKLLRDILRDEWGFRGHVVSDCWAVKDFHENHKVTEGPEQSVKLALENGCDVNCGCTFQFVMSAYAKGLISEETIRTSAVRLFTTRYLLGMMEGSAFDRIGIEALEAKEHLSVAGEAAEKGCVLLKNNGLLPLDAGSIKKIGVIGPNANSRAALIGNYHGTSSRYVTVLEGIQDYLGDDVRVLYSEGCDISNDKVEPLAQDGDRLSEAQAVADASDVVVLVVGLNENLEGEEGDAGNQYVSGDKQDLLLPAPQRKLMQAVFASKKPTVIVLMAGSSIDLEEYGEKADAILLPWYPGARGGKTVADILFGRVSPSGKLPVTFYRNEDLEKIPAFTDYGMKNQTYRYLDFAPLYPFGYGLTYGDCAVETAEACKTGDTVRVRATVKNLSGVATQEVIQVYAQNEGSATAPRNPRLVGFKRISCPPQRSVTEEWEFKAELLDTVGADGRPVFEEHATLYVSLGQPDALTEKLTGHAAIRIGI

SEQ ID NO: 455 - DNA, 1482 bp, Unknown
  Obtained from environmental sample
atgaagcacatctccatgcttgtcaacgccagagacgtcattgcccgcatccgcccggagatctacggccacttcgccgagcatctgggccgctgcatctacggcggcatcttcgtcggcgaaaacagccccatccccaatgtaaagggcatccgcaaggacgtcatcgacgccttccgccacattcaggtacccaccatccgctggcccggcggctgcttcgccgaggaataccactggcaggacggcgtcggcccgctggaaaaccgcaagaagatggtcaacatcaactggggcgcggtggtggaggacaattccttcggtacccacgagtacatggccctgtgcgagctgatcggctccaggccctacatcaacggcaacgtcggctccggcacggtgcaggaaatggccgaatgggtagagtacatgaccgccgtgggcacccctctggccgagcagcggaaagagaacggtcaggacgaaccctggaaggtgcccttcctgggcgtgggcaacgagaactggggctgcggcggcgaaatgaccgccgagacctacgccgccgaattccgccgctacgccgccttctgccgcgagcacaacggcaaccacctctgccgcatcgcctgtggcccgtcctctgccgatttcggctggatggagacgatgatgaaggccatctcgaagggctggggcggttaccccctggccggcggcatcgacctgcattactataccatgcccatccacccgaagatggactccgccacgaagttctccgacgaggagcactacgccaccatggacagcgccttctactgcgacgagctgctgacccgccacaccgagatcatgaaccgctacgacccggagaacagggtgggcctcgtcatcggcgaatggggctgctggcacgaggtggagcccggcaccaaccccggcttcctctatcaacagaacgccatgcgcgacgcgctggtggccgccatccacctcaacatcttcaaccgccacgcaaagcgcgtcatgatggccaaccttgcccagaccgtcaacgtcctgcaggccatcctcctcaccgacggcgaccagctggtcaaaacccccacctattacgtcttcgacctgtacaaggcccatcaaaacggcgccgccgtgtactgctacaccgatgacgagaaggccgccgggggctataaggctccgatgatctcctcctcctgctcggtcaaggacggcgtcatgaccctgacgctggccaattgctccctgacggaggaggccgccatcgactgcgacctctgccacttcgccgctgcggaggccaccgcccgcatcctcaccgcggacgtgcgtgccttcaacgactttgaacacccggaggacgtcgtcatccaccccttcgacgtgaacctcaccggcggcaggctgaccctgaccctgccgccctgctccgtggcggaggtcaccctgcgctga

SEQ ID NO: 456 - protein, 493 aa, Unknown
  Obtained from environmental sample
  DOMAIN (300)...(486): Alpha-L-arabinofuranosidase C-terminus
  SITE (428)...(431): N-glycosylation site. Prosite id = PS00001
  SITE (479)...(482): N-glycosylation site. Prosite id = PS00001
MKHISMLVNARDVIARIRPEIYGHFAEHLGRCIYGGIFVGENSPIPNVKGIRKDVIDAFRHIQVPTIRWPGGCFAEEYHWQDGVGPLENRKKMVNINWGAVVEDNSFGTHEYMALCELIGSRPYINGNVGSGTVQEMAEWVEYMTAVGTPLAEQRKENGQDEPWKVPFLGVGNENWGCGGEMTAETYAAEFRRYAAFCREHNGNHLCRIACGPSSADFGWMETMMKAISKGWGGYPLAGGIDLHYYTMPIHPKMDSATKFSDEEHYATMDSAFYCDELLTRHTEIMNRYDPENRVGLVIGEWGCWHEVEPGTNPGFLYQQNAMRDALVAAIHLNIFNRHAKRVMMANLAQTVNVLQAILLTDGDQLVKTPTYYVFDLYKAHQNGAAVYCYTDDEKAAGGYKAPMISSSCSVKDGVMTLTLANCSLTEEAAIDCDLCHFAAAEATARILTADVRAFNDFEHPEDVVIHPFDVNLTGGRLTLTLPPCSVAEVTLR

SEQ ID NO: 457 - DNA, 1401 bp, Unknown
  Obtained from environmental sample
atgatcaatctttatggcgtctttgacatccggacctttggggcccaaccggacggagaaacgccttccactgcggcgattacggcggccatcgaaacttgtgccgcggccgggggaggagtggtctacatcccggccggacggttcctcaccggtcccctccgcctcaaaagccacgtccggctccatctcgaggccggagcgcacttgctctttagtcaggacccggccgattatcctgttctggagacgaggtgggaggggaaggaggtcttgacctatgcacaccagatctacggcgaggacctcgaaggggtcgcgattaccggtcgggggaccatcgacggccggggcgagacttggtggcgactcttccgcgccaaagccttcacccatccccgaccccgcctcatcgcctttacccgctgcaaggacatcctgatagaaggagtaaccctcgtcaattcaccggcctggaccatcaatcctgtgatgtgcgagcgggtgaccatcgataaggtgactatcatcaacccgcccgactcgcccaacaccgacgggatcgaccccgattcctcccggaacgtctatatcactaactgctacattgacgtaggcgatgactgcatcgccatcaaagcgggccgagaggactccctttatcggacgccttgtgaaaacattgtcatcgccaactgcctcatgcgccacggtcacggcggggtggtcatcggcagcgagaccagcgggggtattcgcaaggtagtcattaccaactgcatcttcgaggacaccgaccggggcattagacttaagtcccggcgcggacgcggcgggttcgtcgaggacctccgggcgacgaatattatcatggaaaaggtgctctgtcccttcgtcctcaacatgtactatgataccgggggaggcgtgatcgacgagcgcgcgcatgacttagaaccccatccggtaagcgaggctacaccctccttccgccgcctctccttcagtcacattactgcccgggaagtgcaggccgccgcggccttcctctacggcctgcccgaacagcctctggaggacgtcttatttgacgatatctggatagagctggccgccgacgcttctcctgcccgtccggccatgatgcgggccgtcccgcccatgagccaaggtggtgtgctctgctacggtgcgcggcggatctccttccggcacatgcacctccgcgggcaccgcggtccggccttccagatcgaacgcgcggaggcggtgcagttgatgggctgctcgaccgacggcagtgaagacccccagcttgtcttgggtcaagcggaggaggtcaccatccgtgactgcacctttaccgcccagcaggaccccgcaaaagaaaggcaaaattaa

SEQ ID NO: 458 - protein, 466 aa, Unknown
  Obtained from environmental sample
  DOMAIN (34)...(390): Glycosyl hydrolases family 28
  SITE (235)...(249): Polygalacturonase active site. Prosite id = PS00502
MINLYGVFDIRTFGAQPDGETPSTAAITAAIETCAAAGGGVVYIPAGRFLTGPLRLKSHVRLHLEAGAHLLFSQDPADYPVLETRWEGKEVLTYAHQIYGEDLEGVAITGRGTIDGRGETWWRLFRAKAFTHPRPRLIAFTRCKDILIEGVTLVNSPAWTINPVMCERVTIDKVTIINPPDSPNTDGIDPDSSRNVYITNCYIDVGDDCIAIKAGREDSLYRTPCENIVIANCLMRHGHGGVVIGSETSGGIRKVVITNCIFEDTDRGIRLKSRRGRGGFVEDLRATNIIMEKVLCPFVLNMYYDTGGGVIDERAHDLEPHPVSEATPSFRRLSFSHITAREVQAAAAFLYGLPEQPLEDVLFDDIWIELAADASPARPAMMRAVPPMSQGGVLCYGARRISFRHMHLRGHRGPAFQIERAEAVQLMGCSTDGSEDPQLVLGQAEEVTIRDCTFTAQQDPAKERQN

SEQ ID NO: 459 - DNA, 1509 bp, Bacillus licheniformis
atgactgtacacaaagcgaagatgacgattgacaaggaatataaggtggcagagattgataagcgaatttacggctcctttatcgagcatctcggcagagccgtttatgaaggcatttatgagcctgatcatcctgaagctgacgaatcaggctttcggaaagatgtcattaaactagtcagagaactaaaggtgccgtttatcaggtatcccggcggaaactttgtatctggatataactgggaggatggagtcggacctgtcgaacagcggccgacaagacttgatttggcgtgggcgacaaccgagccgaacttaatcggtacgaacgaatttatggattgggcaaagcttgtcggggcagaggtgaatatggccgtcaacctcggaacgagaggaattgatgccgcacgcaacctagtagaatattgcaaccatccgtcaggatcgtactacagcgacttgagaaaatcccacggatataaggaaccgcataaaattaaaacatggtgcctcggcaatgaaatggacggtccatggcaaatcggccataaaacagcggccgaatacggaagacttgctgctgaagccgcgaaggtgatgaaatggacggacccgtcgatcgagcttgtcgcctgcggaagttcgggaagcggaatgccgacattcatcgactgggaaacgaccgtgcttgaccatacgtacgaacacgtcgagtacatctcgcttcactcgtattacggcaaccgcgacaatgatcttccaaactatttggcgagatcgctagacatggatcactttatcaaaacggtcatctcagtctgcgactatatgaaagcgaaaaagaaaagcaagaaaacgattcacctttcatatgatgagtggaatgtctggtatcactcgaatgaaaaagacaaagaagctgaacgctgggcgaaagcgccgcaccttcttgaagacatctacaactttgaggatgcgcttctcgtcggctgtatgctgattacgatgctcaagcatgccgaccgcgtgaaaatcgcctgtctggctcagcttgtcaatgtcatcgcgccgattatgacagacaaagggggagaagcatggcgtcagaccattttctatccgtttatgcacgcttccgtctacggcagaggaacggtactgcagacggcggtatcgtctccaaagtatgatgcgaaagactttacggatgtgccgtacttggagtccgtgtctgttttcaatgaagaagccgaggaattaaccgtttttgccgtcaaccgcgcaacagacgccggccttgaaatggaagccgatatgagaagctttgaagggtacagtgtctctgagcacatcgttctggaacacgaagatcataaagcgacgaatgaaaaagaccgcaacaacgtcgttccgcacagcggcggagacgccaaagtatgtgacggcaggctgacggctcaccttccgaagctttcctggaatgtgatcagaatgaagaaacaataa

SEQ ID NO: 460 - protein, 502 aa, Bacillus licheniformis
  DOMAIN (293)...(493): Alpha-L-arabinofuranosidase C-terminus
MTVHKAKMTIDKEYKVAEIDKRIYGSFIEHLGRAVYEGIYEPDHPEADESGFRKDVIKLVRELKVPFIRYPGGNFVSGYNWEDGVGPVEQRPTRLDLAWATTEPNLIGTNEFMDWAKLVGAEVNMAVNLGTRGIDAARNLVEYCNHPSGSYYSDLRKSHGYKEPHKIKTWCLGNEMDGPWQIGHKTAAEYGRLAAEAAKVMKWTDPSIELVACGSSGSGMPTFIDWETTVLDHTYEHVEYISLHSYYGNRDNDLPNYLARSLDMDHFIKTVISVCDYMKAKKKSKKTIHLSYDEWNVWYHSNEKDKEAERWAKAPHLLEDIYNFEDALLVGCMLITMLKHADRVKIACLAQLVNVIAPIMTDKGGEAWRQTIFYPFMHASVYGRGTVLQTAVSSPKYDAKDFTDVPYLESVSVFNEEAEELTVFAVNRATDAGLEMEADMRSFEGYSVSEHIVLEHEDHKATNEKDRNNVVPHSGGDAKVCDGRLTAHLPKLSWNVIRMKKQ

SEQ ID NO: 461 - DNA, 1503 bp, Unknown
  Obtained from an environmental sample
atgaaaaaagcgcgaatgattgtagacaaagaatataaaatcggtgaagtagataaacggatttatggctcgtttatcgaacatatgggtcgtgcggtatatgaaggcatatacgagcctgatcaccctgaagcggatgaagatggatttagaaaagatgtccagtcgctgatcaaagaattacaggttcccatcatccgctatccgggcggaaactttttatccggatacaactgggaggacggtgtcggaccagtcgaaaaccgcccgagacggcttgacttagcatggcaaacgacagaaaccaatgaagtgggaacaaatgaatttttatcttgggccaaaaaggtgaacactgaggtcaatatggccgtcaacctcggcacaagaggcatagatgccgcccgtaatctcgttgaatactgcaaccacccgaaaggctcttactggagtgatttaagaagatcgcatggctatgaacagccgtacggcatcaaaacatggtgcttaggaaacgaaatggatggaccgtggcagatcggccacaaaacagctgatgaatacggacggcttgctgcagagacagcaaaggtcatgaagtgggttgacccatcaattgaactcgttgcctgcggcagctcaaacagcggtatgccgacctttatcgattgggaagcgaaggtgctggagcatacgtatgagcatgtcgactatatctctcttcacacttactacggaaaccgggataacaatctgccaaactacttggcccgttccatggatttggatcattttatcaaatcagtcgctgcgacctgtgactatgtaaaagcaaaaacatgcagcaagaaaacaatcaatctttctctggatgaatggaacgtctggtaccactcaaatgaggctgataaaaaagtcgagccgtggatcactgcgcgtccgattttagaggatatttacaattttgaagatgccttattagtcggctctctgctcattacgatgctgcagcacgcagaccgtgtgaaaattgcgtgtcttgcacagcttgtcaatgtcatcgcgccaatcatgacggaaaaaggcggagaagcatggagacagccgattttctatccatacatgcatgcttctgtttacggaaggggcgagtcactgaaaccgcttatttcttctcctaagtacgattgttctgatttcactgatgtgccatatgttgatgctgctgttgtgtactctgaagaggaagaaacactcactatttttgcggtaaacaaggctgaggatcagatggagacggagatttcgctcagaggctttgaatcctaccaaatcgcagagcacatcgtacttgagcatcaggatatcaaagcgacaaaccagcataacagaaaaaatgtcgttccgcattccaacggatcatcgtctgtcagcgaaaatggcttaactggtcatttcacgccgctttcctggaatgtgatccgcctgaaaaaacagtcataa

SEQ ID NO: 462 - protein, 500 aa, Unknown
  Obtained from an environmental sample
  DOMAIN (291)...(490): Alpha-L-arabinofuranosidase C-terminus
  SITE (291)...(294): N-glycosylation site. Prosite id = PS00001
  SITE (479)...(482): N-glycosylation site. Prosite id = PS00001
MKKARMIVDKEYKIGEVDKRIYGSFIEHMGRAVYEGIYEPDHPEADEDGFRKDVQSLIKELQVPIIRYPGGNFLSGYNWEDGVGPVENRPRRLDLAWQTTETNEVGTNEFLSWAKKVNTEVNMAVNLGTRGIDAARNLVEYCNHPKGSYWSDLRRSHGYEQPYGIKTWCLGNEMDGPWQIGHKTADEYGRLAAETAKVMKWVDPSIELVACGSSNSGMPTFIDWEAKVLEHTYEHVDYISLHTYYGNRDNNLPNYLARSMDLDHFIKSVAATCDYVKAKTCSKKTINLSLDEWNVWYHSNEADKKVEPWITARPILEDIYNFEDALLVGSLLITMLQHADRVKIACLAQLVNVIAPIMTEKGGEAWRQPIFYPYMHASVYGRGESLKPLISSPKYDCSDFTDVPYVDAAVVYSEEEETLTIFAVNKAEDQMETEISLRGFESYQIAEHIVLEHQDIKATNQHNRKNVVPHSNGSSSVSENGLTGHFTPLSWNVIRLKKQS

SEQ ID NO: 463 - DNA, 1509 bp, Unknown
  Obtained from an environmental sample
atgaaaggaatgatcagaggcatgtctgaacatcaagcagtgattcaaacagatatcgtaaaaggaaccattaacaaaaatatatacggtcattttgctgagcatttaggaagagggatttatgaggggatctgggtcggaacggactcagacatccccaatatcaacgggatacgaaaggacgtgctggaggcgctcaaacagctgcacatccctgtcctcaggtggccgggcgggtgttttgcggacgaataccattgggcaaacggtgtcggtgaccgtaagacaatgctgaacactcactggggcggtacaattgaatcaaatgaattcggaacgcatgaatttatgatgctttgcgagctgcttgaatgcgagccatatatttgcggcaatgtcggaagcggaaccgttcaggaaatggcggagtggattgaatatatgacatttgaagaaggcacgccgatgtcagactggagaaagcaaaatggaagagaagagccttggaagctgaaatatttcggcgtgggcaatgaaaactggggctgcggcggcaacatgcatcccgaatactacgcagatctgtaccggcgttttcagacttatgtccgcaattacagtgggaatgacatttataaaattgcaggcggagcaaatgtggatgattttaattggacggacgtgcttatgaaaaaagccgctggcctgatggacgggttgagtcttcattattacacgattccgggggatttctggaacggcaaaggatcagccacagaattcacggaagatgagtggtttattacgatgaaaaaagccaaatacatcgatgaattgattcaaaaacacggcacgattatggaccggtacgatccggagcagcgggtcgggctgattattgatgaatggggcacttggtttgatcccgagccaggcacgaatcccggtttcttatatcagcaaaacaccattcgtgatgcactggtggcggcttctcatttccacattttccatcagcattgccgccgggtgcaaatggccaacatcgcccaaacagtaaacgttctgcaagcgatgattttgactgagggcgagcggatgcttttgacaccgacgtaccatgtattcaatatgtttaaggtgcaccaggacgcttctcttttagcaacagagacaatgtctgccgactatgaatggaagggtgaaacgcttccgcaaatcagcatttcagcgtcgaaacaagctgaaggtgatgtcaatatcactatttgcaacatcgatcaccaaaacaaagcggaggcggaaatcgagctgagaggcctacacaaggcagcggaccatcccggagtcattcttacggcagaaaaaatgaatgcgcataacacgtttgacgatcctcatcatgtcaaaccggaatccttcagacaatacacgctcagcaaaaacaaactgaaagtaaaactcccgccaatgtcagtcgtcttacttacgctgcgtgctgattcttaa

SEQ ID NO: 464 - protein, 502 aa, Unknown
  Obtained from an environmental sample
  DOMAIN (301)...(492): Alpha-L-arabinofuranosidase C-terminus
  SITE (208)...(211): N-glycosylation site. Prosite id = PS00001
  SITE (227)...(230): N-glycosylation site. Prosite id = PS00001
  SITE (426)...(429): N-glycosylation site. Prosite id = PS00001
MKGMIRGMSEHQAVIQTDIVKGTINKNIYGHFAEHLGRGIYEGIWVGTDSDIPNINGIRKDVLEALKQLHIPVLRWPGGCFADEYHWANGVGDRKTMLNTHWGGTIESNEFGTHEFMMLCELLECEPYICGNVGSGTVQEMAEWIEYMTFEEGTPMSDWRKQNGREEPWKLKYFGVGNENWGCGGNMHPEYYADLYRRFQTYVRNYSGNDIYKIAGGANVDDFNWTDVLMKKAAGLMDGLSLHYYTIPGDFWNGKGSATEFTEDEWFITMKKAKYIDELIQKHGTIMDRYDPEQRVGLIIDEWGTWFDPEPGTNPGFLYQQNTIRDALVAASHFHIFHQHCRRVQMANIAQTVNVLQAMILTEGERMLLTPTYHVFNMFKVHQDASLLATETMSADYEWKGETLPQISISASKQAEGDVNITICNIDHQNKAEAEIELRGLHKAADHPGVILTAEKMNAHNTFDDPHHVKPESFRQYTLSKNKLKVKLPPMSVVLLTLRADS

SEQ ID NO: 465 - DNA, 1503 bp, Bacillus halodurans
  misc_feature: Bacillus halodurans ATCC DNA
atgacacttacagcaacaatggttgtcgacaaatcgtttaaaattggcgaaattgataagcgcatttatggttcatttattgagcacctaggacgtgctgtttatgaaggaatttatgaacccggacaccctgatggggatgagcaagggtttcgcaaagacgttatccggctcgttcaagaactgcaagtgccactcgtacgctatcctggcgggaattttgtatccggttacaactgggaggatggggtaggtcctgtttccgaaaggccaaagcggttggatttagcgtggagaacgacggagacgaatgaaatagggacaaatgaatttgttgattgggcgaaaaaggttggggcagaggtgaatatggctgtgaacctcggctctcgcggggttgatgcagcccgtaatcttgttgagtattgtaaccatccgtctggttcttattggagtgatctacgcatctcccatggatacaaagatccgcataatattaaaacatggtgtttagggaatgagatggatggtccttggcaaatcgggcaaaaaacagcagaagaatacggtcgtgtagcggcggaagcaggaaaagtgatgaagctcgtagacccttccatagaactcgttgcttgtgggagctccaacagtaaaatggcaacgttcgccgattgggaagcaacggtcttagaccatacgtacgattatgtagactatatttcgctacatacttattacggaaatcgtgatgatgatctagcaaactatcttgctcagtcgatggatatggatgagttcattcgctcagtgattgcgattgctgattatgtgaaagcgaaaaagcgaagcaaaaaaacgattcatctctcattcgatgagtggaatgtttggttccactccaacgaagcggatcggcaaataactccgtggagtgtagcaccgccattattggaagacatttatacatttgaagatgcccttcttgttggaagcatgctcatcacgttactgaagcatgccgatcgtgtcaaaattgcgtgtcttgctcaactcgtaaatgtcattgctccgattatgactgaaaaaggtgggccggcttggaagcagacgattttttatccgtacatgcacgcatcagtatacggacgtggtgtggctttacaagcgcaaatctcttcacctaaatacgatagtaaagattttacagacgttccttatttggatgcggcggtggtgcatctcgaggaagccgaagaagtgacgatctttgcagttaataaacaccaaacagaatcgctaaatttacaatgtgatatgcgtagctttgaagggtatcacgtattggagcatattgtccttgaacatgaaaatatgaaagcgacaaatcaaggacgagaacaggtaacgcctcatcacaatggtgactccgccattgatcaagggcggctgacagcgaatctagcaaagctatcttggaacgtaattcggctagggaaaaaataa

SEQ ID NO: 466 - protein, 500 aa, Bacillus halodurans
  DOMAIN (1)...(500): Bacillus halodurans ATCC protein
  DOMAIN (292)...(491): Alpha-L-arabinofuranosidase C-terminus
MTLTATMVVDKSFKIGEIDKRIYGSFIEHLGRAVYEGIYEPGHPDGDEQGFRKDVIRLVQELQVPLVRYPGGNFVSGYNWEDGVGPVSERPKRLDLAWRTTETNEIGTNEFVDWAKKVGAEVNMAVNLGSRGVDAARNLVEYCNHPSGSYWSDLRISHGYKDPHNIKTWCLGNEMDGPWQIGQKTAEEYGRVAAEAGKVMKLVDPSIELVACGSSNSKMATFADWEATVLDHTYDYVDYISLHTYYGNRDDDLANYLAQSMDMDEFIRSVIAIADYVKAKKRSKKTIHLSFDEWNVWFHSNEADRQITPWSVAPPLLEDIYTFEDALLVGSMLITLLKHADRVKIACLAQLVNVIAPIMTEKGGPAWKQTIFYPYMHASVYGRGVALQAQISSPKYDSKDFTDVPYLDAAVVHLEEAEEVTIFAVNKHQTESLNLQCDMRSFEGYHVLEHIVLEHENMKATNQGREQVTPHHNGDSAIDQGRLTANLAKLSWNVIRLGKK

SEQ ID NO: 467 - DNA, 1455 bp, Thermotoga maritima
  misc_feature: Thermotoga maritima MSB8 DNA
atgtcctacaggatagtggtggatccaaaagaagttgtcaagccgattagcagacacatctacggtcatttcacggaacatctgggaaggtgtatctacggcggaatttatgaagaaggttctccgctctccgatgaaaggggtttcagaaaggacgttctggaggctgtaaagaggataaaagttccgaacttgagatggcccggtggaaacttcgtgtcgaactaccactgggaagacggaataggtcccaaagatcagaggcctgttaggttcgatctcgcctggcaacaggaagagacgaatagatttggaacggacgaattcattgagtactgtcgtgagataggagcagaaccttacatcagtataaacatgggaactggaacactcgacgaagctctccactggcttgaatactgcaatggaaagggtaatacctactacgctcaactcagaagaaagtacggtcatccagaaccttacaacgtaaagttctggggaataggcaacgagatgtacggggaatggcaggtaggccacatgacggcggacgaatacgcaagagccgccaaagaatacacgaaatggatgaaggttttcgaccctacaattaaagcgatcgccgtgggctgtgacgaccccatatggaatctcagggttcttcaagaagcaggtgatgtgattgacttcatatcctaccatttctacacagggtccgacgattactacgaaacggtctctacggtttaccttctcaaagaaagactcatcggagtgaaaaagctcattgatatggtggatactgctagaaagagaggtgtcaaaatcgcccttgatgaatggaacgtatggtacagagtgtccgataacaagctcgaagaaccttacgatctcaaagatggtatctttgcatgtggagtgcttgtacttcttcaaaagatgagcgacatagtcccacttgccaatctcgcacagcttgtaaacgcccttggagctatacacaccgagaaagacggtctcattctcacacccgtttacaaggcttttgaactcatcgtgaatcattccggagaaaagcttgtcaagacccatgttgaatcggagacttacaacatagaaggagtcatgttcatcaacaaaatgcctttctctgtcgagaacgcaccgttccttgatgccgccgcttccatctcagaagatggcaagaaacttttcatcgctgttgtaaactacaggaaagaagacgctttgaaggttccaatcagagtggaaggtctgggacagaaaaaagccaccgtttatacactcacaggtccggacgtgaacgcgagaaacaccatggaaaatccgaacgtcgttgatattacctccgaaaccatcaccgttgacaccgaatttgaacacacgtttaaaccattctcttgcagtgtgattgaggtagaattggagtaa

SEQ ID NO: 468 - protein, 484 aa, Thermotoga maritima
  DOMAIN (1)...(484): Thermotoga maritima MSB8 protein
  DOMAIN (280)...(475): Alpha-L-arabinofuranosidase C-terminus
  SITE (360)...(363): N-glycosylation site. Prosite id = PS00001
MSYRIVVDPKEVVKPISRHIYGHFTEHLGRCIYGGIYEEGSPLSDERGFRKDVLEAVKRIKVPNLRWPGGNFVSNYHWEDGIGPKDQRPVRFDLAWQQEETNRFGTDEFIEYCREIGAEPYISINMGTGTLDEALHWLEYCNGKGNTYYAQLRRKYGHPEPYNVKFWGIGNEMYGEWQVGHMTADEYARAAKEYTKWMKVFDPTIKAIAVGCDDPIWNLRVLQEAGDVIDFISYHFYTGSDDYYETVSTVYLLKERLIGVKKLIDMVDTARKRGVKIALDEWNVWYRVSDNKLEEPYDLKDGIFACGVLVLLQKMSDIVPLANLAQLVNALGAIHTEKDGLILTPVYKAFELIVNHSGEKLVKTHVESETYNIEGVMFINKMPFSVENAPFLDAAASISEDGKKLFIAVVNYRKEDALKVPIRVEGLGQKKATVYTLTGPDVNARNTMENPNVVDITSETITVDTEFEHTFKPFSCSVIEVELE

SEQ ID NO: 469 - DNA, 1509 bp, Unknown
  Obtained from environmental sample
atgcaagaagctaaaatcactctcgaccgcgacttcgtcatcggccctatcgacccgcgcctctacggctccttcctcgagcatttgggccgggccatctacaccgggatctacgaaccgggccaccccaccgccgacgaactcggctttcgccgggacgtcctggaactcgtgcgtgagctcggtgtccccatcgttcgttacccgggcgggaacttcgtctccggctataattgggaggacggtgtgggacccaggtccgaacgaccacggcgcctggacctgagctggcggacggtggaaacaaacgaggtgggcctcaacgaattcgccgcctgggccaagaaggccggggccgaggtcatgctggcggtgaacctcggcacgcggggcttggacgccgcccgcaacctggtcgagtactgcaaccatcccggcgggagctactggagcgatctccgccgggcccacggcgtggccgaaccgcaccgcatcaaggtctggtgcctggggaacgagatggacgggccctggcagatcgggcacaaaacggcggaggaatacggccgcctggcctgcgagacggccaaggtcatgcggtgggtggacccctccatcgagctcgtggtctgcgggagctcgggctggcagatgcccaccttcccctcttgggagatcacggtcctggaacacacctacgaacacgtggactacctttcgcttcatacttacttcgggaaccgcgacggcgatctggccaacttcctcgcccaatcggtggggatggaccactacatccgcacggccatcgctgcttgtgactacgtccaggcgaagaaaagagggaaaaagcggattaacatctcctttgacgagtggaacgtctggtaccactccaacgaggcggaccggaagatcgaaccctggagtatcgccccgccgcttttagaggatatttataaccttgccgacgcccttgtggtgggctgtatgttgatcaccctcctcaaacacgcggaccggataaagatcgcctgcctggcccagctcgtcaacgtcatcgcgccgatcatgactatgaaggggggaccggcctggcggcagaccatcttctaccccttcctccacgcctcccggtacggtcacggcgtcgccttgcaaacccaagttcgggcgcctctctacgacaccaaggacttcgaagccgtgccgctcctggaggcggtggccacgatggacgaggaagacggggaactcgccatctttgccgtcaaccgttcccaagaggaagcgctggcgctggaggtggagatgcgggggatgagagcggagtatctccctcttgaacacctcgtcctgaccgacgaagacccccaggcggcaaacacggcggccgaaccggaccggattatgccacgccgtcaggacggcgaccgggtggaagacggccgcctcaagaccgtcctccccaagctttcgtggcataccatccgcttgaaaaaagcatga

SEQ ID NO: 470 - protein, 502 aa, Unknown
  Obtained from environmental sample
  DOMAIN (291)...(493): Alpha-L-arabinofuranosidase C-terminus
  SITE (291)...(294): N-glycosylation site. Prosite id = PS00001
  SITE (431)...(434): N-glycosylation site. Prosite id = PS00001
MQEAKITLDRDFVIGPIDPRLYGSFLEHLGRAIYTGIYEPGHPTADELGFRRDVLELVRELGVPIVRYPGGNFVSGYNWEDGVGPRSERPRRLDLSWRTVETNEVGLNEFAAWAKKAGAEVMLAVNLGTRGLDAARNLVEYCNHPGGSYWSDLRRAHGVAEPHRIKVWCLGNEMDGPWQIGHKTAEEYGRLACETAKVMRWVDPSIELVVCGSSGWQMPTFPSWEITVLEHTYEHVDYLSLHTYFGNRDGDLANFLAQSVGMDHYIRTAIAACDYVQAKKRGKKRINISFDEWNVWYHSNEADRKIEPWSIAPPLLEDIYNLADALVVGCMLITLLKHADRIKIACLAQLVNVIAPIMTMKGGPAWRQTIFYPFLHASRYGHGVALQTQVRAPLYDTKDFEAVPLLEAVATMDEEDGELAIFAVNRSQEEALALEVEMRGMRAEYLPLEHLVLTDEDPQAANTAAEPDRIMPRRQDGDRVEDGRLKTVLPKLSWHTIRLKKA

SEQ ID NO: 471 - DNA, 1509 bp, Unknown
  Obtained from environmental sample
atgaaacaggcaagcatgatcctcgacaaggactataccatcggtaagatcgatccccgtatgtacggctcgttcatcgagcatctgggccgcgcggtctacggcggcatctacgagcccggccatcccaccgcggacgagaacggcttccgtcgcgatgtgatggatatggtcaggaatctgggcgttaccatcgtgcgctatcccggcggcaacttcgtttccggcttcaactgggaggattccgtgggtccccgcgagagccgtccgaagcgtctggacctcgcctggcagaccaccgagaccaacgaagtaggcctgcatgaatttgtggagtgggcgcgcaagtccggctccgaagtcatgtatgccgtgaatctgggcacccgcggccccgaagaggcccgcaatgtggtggagtacgccaaccacaagggcggctcctatctctccgacctgcgcattaaaaacggcatgaaggaccccatgggcatcaagctctggtgcctcggaaatgagatggacggcccctggcagatgtgccacaagaccgcttccgagtacggcagaaccgcccacgaggccgcgaagctcatgaagtgggtcgatccctccatcgagtgcgtggtctgcggctcttccggccacaatatgcccacctacggcgactgggaatacgaggtgctttccgagtgctacgacagcgtggattacgtttccctccaccgctactacggaaaccccaccaaggacactcccggcttcctcgcccgcaatatggacctggacgccttcattaaggaagtcgtggccatctgcgatgcggtcaagggcaagaagcacggcaaaaagcagatcaacctctccttcgacgagtggaacgtgtggtatcactcccacgagcaggaccgggaaatctacaagcgtgacaagtggggaagagcactgccccttctggaggatgtgtacaacttcgaggacgccctgctggcgggctccatcctcatcaccttcctgcgcaacgccgaccgcgtcaaggtcgcctgcctcgcgcagctggtcaacgtcatcgcccccatcatgacccgcaacggcggcggagtgtgggcgcagaccatctactggcccttcctgcacgcctccaaatacggccgcggaacggcgctgagagcactcgtaagcagtccctcctacgactgcaaggactatgaaaacgtgccctacgtggacgccaccgccactatggatgatgaaggcaacgtgaccatcttcgccgtgaatcgctccatggaggatgacttcgagctaaccgccgacctgcgctccttcggctctctcaaggcgggcgaacatatcctgctccatcacgacgatgtgaacgcggtcaacaccgaactcgatcctctgaatgtctccccgaaacagggcgaaaaagccaaaatcgacggcggcagcatgagcgttaagctccccgccctcagctggaacgtgatccgcctcaccaaataa

SEQ ID NO: 472 - protein, 502 aa, Unknown
  Obtained from environmental sample
  DOMAIN (291)...(494): Alpha-L-arabinofuranosidase C-terminus
  SITE (291)...(294): N-glycosylation site. Prosite id = PS00001
  SITE (426)...(429): N-glycosylation site. Prosite id = PS00001
  SITE (433)...(436): N-glycosylation site. Prosite id = PS00001
MKQASMILDKDYTIGKIDPRMYGSFIEHLGRAVYGGIYEPGHPTADENGFRRDVMDMVRNLGVTIVRYPGGNFVSGFNWEDSVGPRESRPKRLDLAWQTTETNEVGLHEFVEWARKSGSEVMYAVNLGTRGPEEARNVVEYANHKGGSYLSDLRIKNGMKDPMGIKLWCLGNEMDGPWQMCHKTASEYGRTAHEAAKLMKWVDPSIECVVCGSSGHNMPTYGDWEYEVLSECYDSVDYVSLHRYYGNPTKDTPGFLARNMDLDAFIKEVVAICDAVKGKKHGKKQINLSFDEWNVWYHSHEQDREIYKRDKWGRALPLLEDVYNFEDALLAGSILITFLRNADRVKVACLAQLVNVIAPIMTRNGGGVWAQTIYWPFLHASKYGRGTALRALVSSPSYDCKDYENVPYVDATATMDDEGNVTIFAVNRSMEDDFELTADLRSFGSLKAGEHILLHHDDVNAVNTELDPLNVSPKQGEKAKIDGGSMSVKLPALSWNVIRLTK

SEQ ID NO: 473 - DNA, 1509 bp, Unknown
  Obtained from environmental sample
atgaaaaaggcgtcaatcatcattgacagggattatataacgggaaaaatcgacagacgaatctacggatcgtttatcgagcatcttggccgtgcggtctacggaggaatctatgaacccgggcacccactggcggacgagctgggatttcgcagagacgtgatggaaagcgtgaaaaagctgggggttccgattgtacgctatccgggaggaaatttcgtttccggtttccaatgggaagacagcgtgggaccccgtgcatcccgtccgaaacgattggatctggcatggtttactacggagaccaatgaagtcggtctgcatgaatttgcaggatgggcggaaaaagccggggcagaaatgatgtatgccgtcaacctcggaacccgcggcccggaagaggcgcgggacgtcgtggaatatgcaaaccatacttccgggagcctcttttcggatatgagaattgccaacggaaggaaagatccgtttaatatcaagctgtggtgtcttggaaacgaaatggacggggcatggcagatgggacagaagactgcccgggaatacggcagaacggccaacgaggctgctaagatgatgaagtgggttgacccgaatattgaggtcgttgcctgcggctcatccagctccgaatcaccgactttcggctcctgggagctggaaatgctggacgagtgctatgaaaacgtggattatgtctcacttcaccgctactatggcaacccaacagaggatacgccgggattccttgcgcgcacgatggatatggatgattttatccggagcgttgtttccatgtgcgatgccgttaaggcaaaaaaacgcagcaaacgcacgctgaatctttctttcgatgagtggaacgtatggtatcattctgctgagcaggataaggaaatctggaaacgggataagtggaaccgggcgcttcctttattggaagatgtttataactttgaagacgctcttctggtcgggtccatgctcattaccctcctccgcaacgcagacagggtgaaggttgcatgtcttgcgcagctcgtgaatgttattgcaccgatcatgacccgtaatggcggcggctgctgggcgcagacaatctactatccgttcatgcatgcttcccatttcggtcagggaacggcgctgaaaacattggtcaatacgccgctgtatgattgcaaagactatgagggcgtgccgctgatcgatgccgtggcgacagtagacgatgagggagacgtgacgttgttctgcgtcaaccgtgatatgactgaagattttgcactggatattgaccttcgctcttttggcaggctcacgattaaagagcatattctgctccatcatgatgatgtgaaagctgtcaacacagaggacaatccgatgaatgtcgttccatgcgtcggtccaggaggaacaatcgacggaggaaaggcaactgtgagaattccggcgctgagctggaatgtgatccgatttgcaatataa

SEQ ID NO: 474 - protein, 502 aa, Unknown
  Obtained from environmental sample
  DOMAIN (291)...(494): Alpha-L-arabinofuranosidase C-terminus
  SITE (145)...(148): N-glycosylation site. Prosite id = PS00001
  SITE (291)...(294): N-glycosylation site. Prosite id = PS00001
MKKASIIIDRDYITGKIDRRIYGSFIEHLGRAVYGGIYEPGHPLADELGFRRDVMESVKKLGVPIVRYPGGNFVSGFQWEDSVGPRASRPKRLDLAWFTTETNEVGLHEFAGWAEKAGAEMMYAVNLGTRGPEEARDVVEYANHTSGSLFSDMRIANGRKDPFNIKLWCLGNEMDGAWQMGQKTAREYGRTANEAAKMMKWVDPNIEVVACGSSSSESPTFGSWELEMLDECYENVDYVSLHRYYGNPTEDTPGFLARTMDMDDFIRSVVSMCDAVKAKKRSKRTLNLSFDEWNVWYHSAEQDKEIWKRDKWNRALPLLEDVYNFEDALLVGSMLITLLRNADRVKVACLAQLVNVIAPIMTRNGGGCWAQTIYYPFMHASHFGQGTALKTLVNTPLYDCKDYEGVPLIDAVATVDDEGDVTLFCVNRDMTEDFALDIDLRSFGRLTIKEHILLHHDDVKAVNTEDNPMNVVPCVGPGGTIDGGKATVRIPALSWNVIRFAI

SEQ ID NO: 475 - DNA, 1512 bp, Unknown
  Obtained from environmental sample
atgcagagcggcaagctgtcgatcgaccccgccttcgtcgtagcgcccgtcaaccggcgggtcttcgggtcgttcgtcgagcacatgggtcggtgcgtgtacggcgggctgtacgagcccgggcacccgaccgcggacgaggacggcctgcgcggcgacgtgctcgacctcgtgcgggagatgggcgtcacggccgtgcgctacccgggcggcaacttcgtctcgggataccgctgggaggacggcgtcggcccggtcgaggaccgcccgacccgcctggacccggcgtggaagacggtcgagaccaacgcgttcgggctcaacgagttcatgcgctgggcgcgcaaggccgagatcgagccggtcatggccgtgaacctcggcacgcgcggcatcgccgaggcgatcgagctgctcgagtacgccaaccacccccagggcaccgcgctgtccgacctgcgcgtcgcccacggcgcgccggagccgcacgcgatccgcacgtggtgcctgggcaacgagatggacgggccgtggcagctcggccacaagacggccgaggagtacgggcgcctggccgccgagacggcgcgcgccatgcgccagctcgagccggacctcgagctcgtggcctgcgggtcgtcgggccgggcgatctcgaccttcggcgcgtgggaggacacggtcctcgagcacacgtacgacctggtcgaccacatctcggcgcacgcgtactacgagctcgacggcgacgaccaggccagcttcctggcgtcgtcggtcgacatggacaagttcatccgtgaggtcgtggcgacggccgacgcggtgggtgcgcgcctgaagtcgtcgaagaagatcatgatctcgttcgacgagtggaacgtctggtacaacaaggcgctcaccgagtcgggcctgccgacggactggacgcaggcgccgcggctcagcgaggacgagtacacgctgctcgacgccgtcgtcgtcgggtcgctgctcatcacgctgctgcggcacagcgaccgcgtcgcgatcgcgtgccaggcgcagctcgtcaacacgatcgcaccgatccgctccgagcccggcgggcccgcgtggcggcagtcgatcttccaccccttcgcgctcaccgcgcagcacgcgcagggccaggtgctggacctgcgggtcgacgcgccgaccctgcagaccgccaagcacggcgaggtgtcggtgctcgactccgtcgccacctacgacgcgcagacgggccggctggccgtgttcgtggtcaaccgtgacccctcgcaggccgtcgcgttcgccacggacctgcgggcgttcggcaccgcgaccctcaccgaggcgacggtcctggccggcgacgacgtgctcgccgtcaacacgcaggccgatccggagcgcgtgacgccgcagccgcacacgtcggccacggtcgacggaacgaccctgcgcgccgagctcccggccgcgtcgtggagcatgttcctgctggacacgaccccctga

SEQ ID NO: 476 - protein, 503 aa, Unknown
  Obtained from environmental sample
  DOMAIN (291)...(493): Alpha-L-arabinofuranosidase C-terminus
MQSGKLSIDPAFVVAPVNRRVFGSFVEHMGRCVYGGLYEPGHPTADEDGLRGDVLDLVREMGVTAVRYPGGNFVSGYRWEDGVGPVEDRPTRLDPAWKTVETNAFGLNEFMRWARKAEIEPVMAVNLGTRGIAEAIELLEYANHPQGTALSDLRVAHGAPEPHAIRTWCLGNEMDGPWQLGHKTAEEYGRLAAETARAMRQLEPDLELVACGSSGRAISTFGAWEDTVLEHTYDLVDHISAHAYYELDGDDQASFLASSVDMDKFIREVVATADAVGARLKSSKKIMISFDEWNVWYNKALTESGLPTDWTQAPRLSEDEYTLLDAVVVGSLLITLLRHSDRVAIACQAQLVNTIAPIRSEPGGPAWRQSIFHPFALTAQHAQGQVLDLRVDAPTLQTAKHGEVSVLDSVATYDAQTGRLAVFVVNRDPSQAVAFATDLRAFGTATLTEATVLAGDDVLAVNTQADPERVTPQPHTSATVDGTTLRAELPAASWSMFLLDTTP

SEQ ID NO: 477 - DNA, 1518 bp, Unknown
  Obtained from environmental sample
atgaaaaatgcttcaattgttcttgataaggatttcgttgtcggagagatagacaaaaggatctatggctcgttcatcgagcatctcggccgagcggtctacggcggaatatatgaacccggtcatcctcttgcggacaagcacggctttcgcaaagatgttctcgagagtgtgaagaagctcggtgttcccatcgtgcgttatcctggcggcaatttcgtctccgggtttaattgggaagacagcgtgggcccggtcagtcagcgcccgaatcgccttgacctcgcctggttcacgacggagacgaacgaggtcggtctgcatgagttcgcagactgggcgaaggaagccgggagcgaccttatgtatgccgtcaacctcggtacgcgtggtccggagagtgcgagagacattgttgaatacgccaatcacccatccggcagtctctattcagacatgcgcatttccaacggccgcaaagaccccttcaatatcaaactctggtgtctcggcaatgagatggacggcccctggcagatgggccataaaacggcttatgaatacggccggacggccaatgaagccgccaagatgatgaagtgggtcgacccgtcaatcgaatgcgttgcctgcggctcatctcacagtgagatgccgactttcggcgaatgggagtatacgatgctcggtgaatgctatgagaacgtggactacgtctcccttcaccggtactacggtaatcctaccggtgacactccgggcttcctcgcccgagcgatggatatggacgacttcatcaagagcgtgatttccatctgcgatgccgtcaagggcagaaagcacagcaagaagcagatcaacctgagttttgacgagtggaacgtatggtatcactccagcgagcaggataaagaaatctggaagatggataagtggaaccgtgctcttccacttctggaggacgtctacaactttgaagacgcgctcctcgtcggctccatgctcatcactctcttacgtaatgctgaccgcgtgaaggttgcatgtctggcgcagcttgtcaacgtcatcgcgccgataatgacccgtaacggcggaggctgctgggcacagacaatctattatcccttcatgcatgcctcgaagtacggccgtggaacggcactcaggacgctcatctcctcccccgtttatgactgcattgactatgaagccgtgccatatatcgactcagtcgccacgatggacgacttcggcaatgtcactctcttctgcgtcaaccgcgacctggcagaggacttcagtctcagccttgacctgcgctcattcgggaagatggaacttgcagaacacattctgcttcaccacgacgacgtaaaggcggtgaataccgaaacgaatcccgaaaacgtcattccgacggccgggccgggcggaaaggccgagagcggaaggttcgagctccgcatcccggctctcagttggaacgtcatccgctttacgccgagcaagaagtaa

SEQ ID NO: 478 - protein, 505 aa, Unknown
  Obtained from environmental sample
  DOMAIN (291)...(494): Alpha-L-arabinofuranosidase C-terminus
  SITE (3)...(6): N-glycosylation site. Prosite id = PS00001
  SITE (291)...(294): N-glycosylation site. Prosite id = PS00001
  SITE (426)...(429): N-glycosylation site. Prosite id = PS00001
MKNASIVLDKDFVVGEIDKRIYGSFIEHLGRAVYGGIYEPGHPLADKHGFRKDVLESVKKLGVPIVRYPGGNFVSGFNWEDSVGPVSQRPNRLDLAWFTTETNEVGLHEFADWAKEAGSDLMYAVNLGTRGPESARDIVEYANHPSGSLYSDMRISNGRKDPFNIKLWCLGNEMDGPWQMGHKTAYEYGRTANEAAKMMKWVDPSIECVACGSSHSEMPTFGEWEYTMLGECYENVDYVSLHRYYGNPTGDTPGFLARAMDMDDFIKSVISICDAVKGRKHSKKQINLSFDEWNVWYHSSEQDKEIWKMDKWNRALPLLEDVYNFEDALLVGSMLITLLRNADRVKVACLAQLVNVIAPIMTRNGGGCWAQTIYYPFMHASKYGRGTALRTLISSPVYDCIDYEAVPYIDSVATMDDFGNVTLFCVNRDLAEDFSLSLDLRSFGKMELAEHILLHHDDVKAVNTETNPENVIPTAGPGGKAESGRFELRIPALSWNVIRFTPSKK

SEQ ID NO: 479 - DNA, 1017 bp, Unknown
  Obtained from environmental sample
atgaagacgttcatccttgccgctgccgcgttgggcgtcgccatgccaggcgtcgcccaaccgcccatgcagagtgcgatgaaccgcaggatcgcaggcgatatcgccccggtccatgacccggtcatcgctcgcgaaggagacacttattacgtcttctccaccggtggatcgaaagaaagcggcgggttcatccccattcgcacgtccaaggatcttatccactggactgcgcagagcgcggccctttcggccttgccagactgggcgaccaaggccgtcccgggctcgcgcgacctttgggcccctgacatatccttcgcgaacggtcgttggcgcctatattattcggtgtcgaccttcggctccaatcactccgccatcggtctggccacgagtccgaccctcgaccccaaggctcctggctacggctggcgcgatgagggggtcgtggtacgctcgacgcgggacagcgatttcaacgcgatcgatcccaatttcgtgatcgaccgcgaagggagacattggctttcgctgggcagtttctggagcgggctgaagcttcttgcactagacaaggagggcaaggtgcgaccagacaccgcaccggtttcgattgcccagcggcctgcgccggccggcgccccggccccggtcgaggcgcccttcattatcgaccgcggcggctattattggctgatcgcgtcctacgattattgctgcaagggcgtgaacagcacttactacaccgtgatcgggcggtcgaaggacattaccggcccctatctcggcaaggacggaagttcgatgatgaaggggggagggacaatccttcttcgagccgacctgcccgaacagcagcaattccgcggtccgggccatgccggcgtgctgcgtgacggagagagagattacctcgtctatcacgcctatgatcgcgagaaaaagggcgtgcctaccctacggatcgctccgctgaaatggggcgccgatggctggcctgttgccgaatattga

SEQ ID NO: 480 - protein, 338 aa, Unknown
  Obtained from environmental sample
  SIGNAL (1)...(19)
  DOMAIN (31)...(334): Glycosyl hydrolases family 43
  SITE (125)...(128): N-glycosylation site. Prosite id = PS00001
  SITE (248)...(251): N-glycosylation site. Prosite id = PS00001
MKTFILAAAALGVAMPGVAQPPMQSAMNRRIAGDIAPVHDPVIAREGDTYYVFSTGGSKESGGFIPIRTSKDLIHWTAQSAALSALPDWATKAVPGSRDLWAPDISFANGRWRLYYSVSTFGSNHSAIGLATSPTLDPKAPGYGWRDEGVVVRSTRDSDFNAIDPNFVIDREGRHWLSLGSFWSGLKLLALDKEGKVRPDTAPVSIAQRPAPAGAPAPVEAPFIIDRGGYYWLIASYDYCCKGVNSTYYTVIGRSKDITGPYLGKDGSSMMKGGGTILLRADLPEQQQFRGPGHAGVLRDGERDYLVYHAYDREKKGVPTLRIAPLKWGADGWPVAEY

SEQ ID NO: 481 - DNA, 1509 bp, Unknown
  Obtained from environmental sample
atgaaaaaagcaaccatgattatggacaaggattttgccatcggcaagatcgacccccgcatctatggctcctttatcgagcatctgggccgtgccgtgtacggcggcatctatgagcccacccaccccactgctgacgagaacggcttccgtcaggacgtgatcgacatggtgcgcaagttgaacgtgccggtcacccgctatcccggcggcaacttcgtttccggcttcaactgggaagacagcgttggcccccgggatcagcggcctcatcggctggatctggcctggttcaccaccgagaccaatgaggtgggtctccacgaattcgtggattgggccaagaaggccaacaccgaagtgatgtacgccgtcaatctgggcacccgtggccccgatgcagcccgcaatgtggtggaatacgccaaccacaagggcggtagctactggagcgacctgcgcatcaagaacggtgccaaggatcccttcggcatcaagctgtggtgcctgggcaacgaaatggacggcccctggcagatgggtcagaagaccgcctacgaatacggccgtgtggccagcgaagccggtaagatgatgaagtgggtggatccctccatcgagctggtggcctgcggttcctcctccttccagatgccaaccttcggcacctgggagtacgagatgctcacccagtgctacgatcagatcgactatgtgagtctgcaccgctactacggcaaccaaaccaacaacaccccagatttcctggcccgcaacatggacctggacggtttcatcaaaactgttgtggccatctgcgatgccgtgggcggcgccaagcactccaagaagaagatcaacctgtcctttgacgagtggaacgtgtggtaccactccaacgagcaggacaaggaagtgtggaagcaggacaagtggaaccgtgccctgccccttctggaggacatctacaacttcgaggatgcgctgctggtgggcgccatgctgatcaccttcctgaagaatgccgaccgtgtgaaggtggcttgccttgcccagctggtgaacgtgatcgcgcccatcatgacccgcaacggcggcggcgtgtgggcccagaccattttctggcccctgatgcacgcctccaagtacggccgcggcaccgccctgcgccccgtcattgacagccccacctacgactgctccgactatgagcaggtgccgctggtggatggcaccgccaccctgggggacgacggctccgtgaccatcttcgccgtgaaccgtgacatgaacgaggatatcgtgctgaatgccgacctgcgcggcttcggcgatttgaagatcgccgagcatatcgtgctgcaccacgacgacgtgaaagccatcaacaccgaagccaaccccgacaacgtggctcccgctgcgggcaacggcggcatcatcggcggcggacagctggaagtgaagctgcccagcctgagctggaatgtgatccgtttggtgaagtaa

SEQ ID NO: 482 - protein, 502 aa, Unknown
  Obtained from environmental sample
  DOMAIN (291)...(494): Alpha-L-arabinofuranosidase C-terminus
  SITE (250)...(253): N-glycosylation site. Prosite id = PS00001
  SITE (291)...(294): N-glycosylation site. Prosite id = PS00001
MKKATMIMDKDFAIGKIDPRIYGSFIEHLGRAVYGGIYEPTHPTADENGFRQDVIDMVRKLNVPVTRYPGGNFVSGFNWEDSVGPRDQRPHRLDLAWFTTETNEVGLHEFVDWAKKANTEVMYAVNLGTRGPDAARNVVEYANHKGGSYWSDLRIKNGAKDPFGIKLWCLGNEMDGPWQMGQKTAYEYGRVASEAGKMMKWVDPSIELVACGSSSFQMPTFGTWEYEMLTQCYDQIDYVSLHRYYGNQTNNTPDFLARNMDLDGFIKTVVAICDAVGGAKHSKKKINLSFDEWNVWYHSNEQDKEVWKQDKWNRALPLLEDIYNFEDALLVGAMLITFLKNADRVKVACLAQLVNVIAPIMTRNGGGVWAQTIFWPLMHASKYGRGTALRPVIDSPTYDCSDYEQVPLVDGTATLGDDGSVTIFAVNRDMNEDIVLNADLRGFGDLKIAEHIVLHHDDVKAINTEANPDNVAPAAGNGGIIGGGQLEVKLPSLSWNVIRLVK

SEQ ID NO: 483 - DNA, 1527 bp, Unknown
  Obtained from environmental sample
gtgagccagccagatcccgccgcagcaaagatcaccgtcgatccctctttcatcgtggggccggtccgccgtcgtactttcggtgctttcgttgaacacctcggccggtgcgtgtacaccggcatcttcgaacccggccaccctgacgcggacggggacggcttccgcaaggacgtcctggaactgacccgcgaactgggcgtatcaacggtgcggtacccgggcggcaactttgtctccggctaccgctgggaagacggcgtggggcccgtggaccagcgccccacccggctggacctggcctggcactcaaccgaccccaatacggtgggcgtggacgagttcgccaagtggtgcgccaaggcaggggtggaacccatgatggccgtcaacctgggcacccgcggtgtccaggaggcgctggacctcctggagtactgcaacatcgacggcggtaccgccctttccgaccagcgccgcgcgaacggagccgcaaatggttacggcatcaggatgtggtgcctgggcaacgagatggacggcccctggcagatcggccacaagaacgccctcgagtacgggcggctggcggcggacacggcccgcggcatgcggatgatcgatccggacctggagctggtggcctgcggcagctccggccccaccatgcccaccttcggtgagtgggagcgcgtggtcctgacggagacctacgacctggtggacctcgtctccgcgcaccagtacttcgaggacttcggcgacctgcaggaacacctcgcagccgcacacaaaatggacgccttcatcggtgacatcgtgagccacatcgaccacgtgaagtcggtgaagaagtccaccaggcaggtgaacatctctttcgatgagtggaacgtgtggcacatgagccgtgacgaatccaaagtgcccacgggcacggattggcctgtggctcccgtactgctggaggacacctacacggtggcggacgccgtcgtagtaggggacctcctcatcacgctgctcaggaacactgaccgggtgcattcggcaagcctggcgcagctggtgaacgtgatcgcgcccatcatgaccgagcccggcggccggtcatggaagcagaccaccttccaccccttcgccctgacctcccggcacgcgtcgggaacagtgctgcagctcgccgtcgaatccccgctggtcagcggcggcaagacctccggcttcgcggccctctctgccgtcgcaacgtatgacgcggacaagggcgagaccgtggtgttcgcggtcaaccgctccgccggccaggcgctcatcctggatgctgcggtagccgccctcggcgatgtccgcgtggtggaggcggtgacctacgccaacaaggacccctactggcaggccagcgcggacgattccacctcagtgctgccctcggacaacggcaccgtgcaggtggacggcggccggctcaccgcagagcttccggccgtgtcctggtccatgatccggctggcagtgggcaaataa

SEQ ID NO: 484 - protein, 508 aa, Unknown
  Obtained from environmental sample
  DOMAIN (295)...(498): Alpha-L-arabinofuranosidase C-terminus
  SITE (295)...(298): N-glycosylation site. Prosite id = PS00001
  SITE (437)...(440): N-glycosylation site. Prosite id = PS00001
  SITE (487)...(490): N-glycosylation site. Prosite id = PS00001
MSQPDPAAAKITVDPSFIVGPVRRRTFGAFVEHLGRCVYTGIFEPGHPDADGDGFRKDVLELTRELGVSTVRYPGGNFVSGYRWEDGVGPVDQRPTRLDLAWHSTDPNTVGVDEFAKWCAKAGVEPMMAVNLGTRGVQEALDLLEYCNIDGGTALSDQRRANGAANGYGIRMWCLGNEMDGPWQIGHKNALEYGRLAADTARGMRMIDPDLELVACGSSGPTMPTFGEWERVVLTETYDLVDLVSAHQYFEDFGDLQEHLAAAHKMDAFIGDIVSHIDHVKSVKKSTRQVNISFDEWNVWHMSRDESKVPTGTDWPVAPVLLEDTYTVADAVVVGDLLITLLRNTDRVHSASLAQLVNVIAPIMTEPGGRSWKQTTFHPFALTSRHASGTVLQLAVESPLVSGGKTSGFAALSAVATYDADKGETVVFAVNRSAGQALILDAAVAALGDVRVVEAVTYANKDPYWQASADDSTSVLPSDNGTVQVDGGRLTAELPAVSWSMIRLAVGK

SEQ ID NO: 485 - DNA, 1515 bp, Unknown
  Obtained from environmental sample
atgaagaaagctaagatgatcctggacaaggattttgttgttggtaaaatagacaaaaggatctacggctcctttatagagcatctgggacgcgccgtttacggaggcatatacgagcccggacatccaatggccgatgagctggggtttcgaaaggatgtcatggagttcgtaaagaagctcaatgtgccgatagtacgctacccgggaggaaattttgtttcgggctttcactgggaggacagcgtggggcccagggataaaaggccgaaacgcctggatctggcctggtttactaccgagacaaatgaggtgggcctgcacgaatttgccgactgggcgaagaacgcgggaagcgatataatgtacgccgtaaacctcggcagcaggggaccggagcaggccagggatatcgtggaatacgcaaaccacccctcgggcagtaagttctctgatatgcgtatcgcaaacggcagaaaggatccctttaatatcaagctctggtgtctgggaaatgaaatggacgggccctggcagatggggcagaagaccgcgacggaatacggacgcattgccaatgaggcggccaagatgatgaaatgggttgatccttccatcgagcttgtggcctgcggttcctcctccaccgaaatgcccaccttcggaacctgggagcttacgatgcttgatgagtgctatgaaaacgtggactatgtgtcactccaccgctactatggcaatcctaccgctgatactccgggcttccttgcaagaaccatggatatggatgatttcataaagagcgtggcatcgatctgcgatgccgtcaagggcaaaaagcacagcaagcatgtggtgaacctgtcctttgatgagtggaacgtatggtatcattccaacgagcaggataaggagatatggaagcaggataagtggaaccgtgcccttccgctcctggaggatgtatataactttgaggatgcccttctggtagggtcgatgctgataactctgcttaagaacgcagaccgtgtaaaggttgcctgtcttgcacagcttgttaatgtcatagcgcccatcatgacaaggaacgggggaggcgcctgggcacagaccatcttctatcccttctgccatgcttcaacctatggccgcggtacatctcttaaggcccttgtggagagccctgtatactcctgcaaggactatgatgatgttccttatatcgatgcgaccgctacaatggacgacgaaggcggcgtgaccgtctttgccgttaaccgtgatatggaagaggattatgagctggaggcagacctgcgttccttcggggagcttgcgatttcggagcatatcgttcttcatcacgacgatgtgaaggctgtcaacacggaggatgctcccgagaacgttgttcccggaaagggagagggcggcaccgtttctgacggtaaggcatccgtaaagctcaggcccctcagctggaatgttatccggtttgcaaagaggaagtaa

SEQ ID NO: 486 - protein, 504 aa, Unknown
  Obtained from environmental sample
  DOMAIN (291)...(494): Alpha-L-arabinofuranosidase C-terminus
  SITE (291)...(294): N-glycosylation site. Prosite id = PS00001
MKKAKMILDKDFVVGKIDKRIYGSFIEHLGRAVYGGIYEPGHPMADELGFRKDVMEFVKKLNVPIVRYPGGNFVSGFHWEDSVGPRDKRPKRLDLAWFTTETNEVGLHEFADWAKNAGSDIMYAVNLGSRGPEQARDIVEYANHPSGSKFSDMRIANGRKDPFNIKLWCLGNEMDGPWQMGQKTATEYGRIANEAAKMMKWVDPSIELVACGSSSTEMPTFGTWELTMLDECYENVDYVSLHRYYGNPTADTPGFLARTMDMDDFIKSVASICDAVKGKKHSKHVVNLSFDEWNVWYHSNEQDKEIWKQDKWNRALPLLEDVYNFEDALLVGSMLITLLKNADRVKVACLAQLVNVIAPIMTRNGGGAWAQTIFYPFCHASTYGRGTSLKALVESPVYSCKDYDDVPYIDATATMDDEGGVTVFAVNRDMEEDYELEADLRSFGELAISEHIVLHHDDVKAVNTEDAPENVVPGKGEGGTVSDGKASVKLRPLSWNVIRFAKRK

SEQ ID NO: 487 - DNA, 1515 bp, Unknown
  Obtained from environmental sample
atgaaaaaagccaccatgatcctggacaaagacttctcgatcggcaagatcgacccccgcatgtacgggtccttcatcgagcacctgggccgcgcggtctacggcggcatctatgagcccacccatcccaccgcggataagaacggcttccgccgcgacgtcattgaaatggtccggaagctcggcgtcccggtcgtccgctatcccggcggcaacttcgtctccggcttcaactgggaggattccatcggcccgcgggaccaacggccgaagcgcctggacctggcctggttcaccaccgagaccaacgaggtcggcctgcatgagttctgcgactgggcgaaggcggcggacaccaccgtcatgtacgcggtgaacctcggcacccgcggcccggacgcggcccgcaacgtcgtcgagtacgccaaccacaagggcggcagctactggtccgacctgcggatcaaaaacggcgcgaagaacccgctggggatcaagctctggtgcctgggcaacgagatggacggtccctggcagatcggccacaagactgcctacgagtacggccgcgtagctaacgaggccgccaaggtcatgaagtgggtcgacccctccatcgagctggttgcctgcggcagcgccgcccacgacatgccgacctacggcgactgggaatacaccatgctcaacgagtgctacgagaacgtggactacgtctccctccaccgctactacggcaaccccaccaacgacacccccggcttcctggcccgcagcatggacctggatgatttcatcagggaagtcgtcgcgatctgtgatgccgtcggcggccggaagcattcaaagaagaagctgaacctgtcctttgacgagtggaacgtctggtaccactccaaccagcaggaccaggaggtctggaaggcggacaagtggggccgcgccctgccgctgctcgaggacgtctacaactttgaggacgcgctgctcgccggcgcgatcctgatcaccttcctgaagaacgccgaccgcgtgaaggtcgcctgcctcgcccagctggtgaacgtcatcgccccgatcatgacccgcaacggcggcggcgtctgggcccagacgatcttctggccgatgatgcacgcctcgaagtacggccggggcaccgccctgcggcccgtcctctcctccccggtctacgactgcagggacttcgagaaggtcccgttggtggacgccgcggcgaccctcggggacgacggcagcgtcacgatcttcgcgatcaaccgggacgggaaggaggacatcgccctcgattgcgacctccgcgccttcagcggcctggtgcctgccgagcacatcgtcctgcaccatgacgacgtgaaggccgtcaacaccgagaagaaccctgacgaggtggtcccgaagaacggccgcaaggcgaagctcgacgttggaaagatgaccgtcaaactccccgccctctcctggaacgtcatccgcctgaccccggaaaaataa

SEQ ID NO: 488 - protein, 504 aa, Unknown
  Obtained from environmental sample
  DOMAIN (291)...(494): Alpha-L-arabinofuranosidase C-terminus
  SITE (291)...(294): N-glycosylation site. Prosite id = PS00001
MKKATMILDKDFSIGKIDPRMYGSFIEHLGRAVYGGIYEPTHPTADKNGFRRDVIEMVRKLGVPVVRYPGGNFVSGFNWEDSIGPRDQRPKRLDLAWFTTETNEVGLHEFCDWAKAADTTVMYAVNLGTRGPDAARNVVEYANHKGGSYWSDLRIKNGAKNPLGIKLWCLGNEMDGPWQIGHKTAYEYGRVANEAAKVMKWVDPSIELVACGSAAHDMPTYGDWEYTMLNECYENVDYVSLHRYYGNPTNDTPGFLARSMDLDDFIREVVAICDAVGGRKHSKKKLNLSFDEWNVWYHSNQQDQEVWKADKWGRALPLLEDVYNFEDALLAGAILITFLKNADRVKVACLAQLVNVIAPIMTRNGGGVWAQTIFWPMMHASKYGRGTALRPVLSSPVYDCRDFEKVPLVDAAATLGDDGSVTIFAINRDGKEDIALDCDLRAFSGLVPAEHIVLHHDDVKAVNTEKNPDEVVPKNGRKAKLDVGKMTVKLPALSWNVIRLTPEK

SEQ ID NO: 489 - DNA, 1506 bp, Unknown
  Obtained from environmental sample
atgaagaaagcaaggataataatagataaggattttaccataggcgagatcgacaagaggatattcggctcctttatagagcatctgggccgcgccgtgtacggaggcatatatgagccgggtcatcccgaggctgatgagctgggctttcgtaaggatgttttaggcctggtaaaaaagctcaatataccggtagtccgctatcccggcggaaatttcgtatccggctttaactgggaggacagcgtaggacccagggagaagcgcccgaagaggctggatctggcctggtttactacggagacgaacgaggtggggcttcatgaattcgcggactggacgaagaaggccggaagtgagcttatgtatgcggtaaacttaggcagcaggggccccgagcaggccagggatattgtggaatatgccaatcatatttccggcagcaaatattccgatatgcgtattgccaacggaagaaaggagcccttcgggataaagctctggtgcctgggcaatgagatggacgggccctggcagatggggcagaagagcgcaagggaatatggccgggtggccaatgaagccgccaagatgatgaaatgggtggatccctccatcgaggtagtggcctgcggctcctcctctacggagatgcccaccttcggctcctgggagctggaaatgctggaggaatgctatgaaaacgtggattatgtatccctccacaggtattacggcaatcccaccggggatacaccgggcttccttgccaggaccatggatatggacggctttataaaaagcgttgccgcgatctgtgatgcggtcaggggaaagaagcacagctcccatatcgtgaatctttcctttgatgaatggaatgtctggtatcattcaaacgagcaggataaggagatctggaagcaggacaaatggaacagggcccttccgcttctggaggatgtttataattttgaggatgcactcctggtgggttcaatgctcatcacccttattaaaaacgctgacagggtaaagatagcctgcctggcccagctcgttaatgtcatcgcacccatcatgaccaggaacggcgggggagtatgggcccagaccaccttttatccctttatgcatgcctctctttacggccgcggtgtcgcgctcaatgcccttacagacagtcccgtttattcctgtgaggactatgaaaatgtacccttcatagacgctgcggcggtgatggatggcgatgagcttaccgtttttgcggttaaccgggatatggaggaggattacgagctggagcttgacttaaggtgctttaaggagctgtctgtaaaggagcacatcctgctgcatcatgatgacgtaaaggcggtcaataccgaggaggcccctgaaaccgttgtccctgtggcaggaccgggcggaaggctcgagggaggaaaggcgacggtcaggataccggccttaagctggaatgtgatacgttttacggtataa

SEQ ID NO: 490 - protein, 501 aa, Unknown
  Obtained from environmental sample
  DOMAIN (291)...(493): Alpha-L-arabinofuranosidase C-terminus
  SITE (291)...(294): N-glycosylation site. Prosite id = PS00001
MKKARIIIDKDFTIGEIDKRIFGSFIEHLGRAVYGGIYEPGHPEADELGFRKDVLGLVKKLNIPVVRYPGGNFVSGFNWEDSVGPREKRPKRLDLAWFTTETNEVGLHEFADWTKKAGSELMYAVNLGSRGPEQARDIVEYANHISGSKYSDMRIANGRKEPFGIKLWCLGNEMDGPWQMGQKSAREYGRVANEAAKMMKWVDPSIEVVACGSSSTEMPTFGSWELEMLEECYENVDYVSLHRYYGNPTGDTPGFLARTMDMDGFIKSVAAICDAVRGKKHSSHIVNLSFDEWNVWYHSNEQDKEIWKQDKWNRALPLLEDVYNFEDALLVGSMLITLIKNADRVKIACLAQLVNVIAPIMTRNGGGVWAQTTFYPFMHASLYGRGVALNALTDSPVYSCEDYENVPFIDAAAVMDGDELTVFAVNRDMEEDYELELDLRCFKELSVKEHILLHHDDVKAVNTEEAPETVVPVAGPGGRLEGGKATVRIPALSWNVIRFTV

SEQ ID NO: 491 - DNA, 1434 bp, Unknown
  Obtained from environmental sample
gtgagcaaccctgccaccccgcccgcagtcggcgtcctcgacgagcgtgcgccgctgaccttcccgccgggcttcctctggggagcggccaccgccgcgtaccagatcgaaggggcagcggccgagggtgggcgcaccccgtcgatctgggacaccttcagccacacggagggcaagacggtctccgggcacaccggtgacgtcgcctgcgaccactaccaccggctctccgacgacgtgcggctgatggccgagctggggttgaagtcgtaccgcttctccgtctcctggccgcgggtgcagccgggcgggtcgggaccggtgaacgccgaagggctggacttctaccggcggctggtcgacgagttgctgaccaacggcatcgagccctggatcaccctctaccactgggacctgccccaggagttggaggacgccggcggttggccggcccgggacaccgccgcccggttcgccgactacgcccagctgatggcggacgcgctgggtgaccgggtgaagtactggaccaccctcaacgagccctggtgctcggccttcctcggctacggctccggcgtacacgcgccgggccgctcggacggcgccgccgccgtccaggccgggcaccacctgatgctcggccacgggctcgcggtgcaggcgctgcgcgcggctcggccggaggcgcagctcggcgtgaccgtcaacctgtacccggtcacgccggccagcgacacgcccggcgacgtggacgccgcccggcgcatcgacgggctggccaaccggttcttcctcgacccgctgctgcgcggggagtaccccgcggacctggtcgccgacctggccaaggtgaccgacttcgggcacgtgcgggacggggacctggccgtgatcgccacgccgctggacctggtcggggtgaactactacagccggcacgtggtggccgcgccggcagccggcgaggagccggagaagtactggcgggcgccgtcctgctggccgggcagcgaggaggtccggttcgtcacccggggcgtgccggtgaccgacatgggctgggagatcgacgcacccggcctggtggagacgctgcgccgggtccacgaggagtacaccgacctgccgctctacgtgaccgagaacgggtccgccttcgtcgacgcggtggtcgacggccgggtggacgacaccgaccggctggcgtacttcgacgcgcacctgcgggcctcgcacgaagcgatcagcgccggagtgcccctgcaggggtactttgcctggtcgctgttggataatttcgaatgggcctggggttacaccaagcggttcggcatggtctacgtcgactacgacagccagaagcgcattcccaagtccagtgccaggtggtacgcggaggtgattcgacgcaacggtctggccgcacaataa

SEQ ID NO: 492 - protein, 477 aa, Unknown; identical to SEQ ID NO: 398
  Obtained from environmental sample
  DOMAIN (17)...(474): Glycosyl hydrolase family 1
  SITE (25)...(39): Glycosyl hydrolases family 1 N-terminal signature. Prosite id = PS00653
  SITE (388)...(391): N-glycosylation site. Prosite id = PS00001

SEQ ID NO: 493 - DNA, 2592 bp, Unknown
  Obtained from environmental sample
ttgtcacacaaaaccatacgcgcatttgtacagaagtttgccgttttggccttgacggcggttccttttccacacgacactcactttatcgtgagcacatacccgaacgccgtgtctcagcgcatggcgatattaaaaacagggagtaaaccaacaatgattcatatcaaaacccccaagctgtcgcgccgcctgttcggcgcttccagtttcgcgctgatgctgagcgcggccacacatgctgcggcacaaaaggcgaaaatgcccaaaatgccaaagctggccaaggacgctccgctctataagcaaccgaacgcgccgatcaatgatcgcgtcgaggacttgctgggccgcatgacgctggaagaaaaagtagctcagatgcagtgcatctggcagatgaaagcccgcgttcaggacgctcagggcaatttcgacgctaaaaaggcgtcggctgagcatccgaacggcatgggtatgctgggccgccccagcgatcgtcgtatggccgccatcgacgtggccggcgcggctgccggtgacgcgggcgatattcagaaccgcaacgcctatgatacggcggtctatgtcaacgccgctcagcgctgggccgttgaggacacccgtctcggcatcccgatgatgacccacgaagaatcgctgcacggctatgtggcccgcgatgcgacttccttcccgcaggccattggtctggcctcgtccttcgatcccgaaatggccgagcgtatcttcagcgtctgcgcgcgtgaaatgcgcgcgcgcggtgcgttcctggcgctgtcgcccgtggtggatattgcccgcgatccgcgttggggccgtatcgaagaaacctatggcgaagacgcgcacgtcaacgccgaaatgggtatcgcggcggttaacggctttaccggccgcacgcttccgttggccaaggataaggtgttcgccacgcttaagcacatgaccggtcacggtgagccgcaaaacggcacgaacgttggcccggcacaggtgtccgagcgcgtgctgcgtgaagacttcttcccgccgttcgagcgtatcatcaaggaaaccaaaattgcggcggtcatgccgtcctataacgaaatcgacggtctgccgtcacacgccaaccgctggctgctgacgaccattctgcgcggcgagtggggctttgaaggtacgacggtgtccgactattacgccatccgcgaactgatcgagcgtcacaagctggtgcctgatcttaaggaagccgcctatcgtgccgtccatgccggtgtggatgtcgaaaccgctgaccccagcgcctatccgtttatccctgagctgattgccgaaggccgtctgacccttgacgaagttgatggtccggtgcgtcgtattctgcgtgaaaagttcgaggcgggtctgtttgaaaacccctatgtcgacccgaacgtcgctgacagcctgaccggcctgccggacgctgtggctctggcccatgaagcggctaccaaatcggtggttctgctgaagaacaatggcctgctgccgctggtgcataacaaggtgggcaaggtgctggttctgggtacgcacgccaaagacacccccatcggcggttattccgacattccgcgtcacgttgtgtcgatccttgatggtcttgaaaaagaaggcaaggagcacggctttgaagtggcctattccgaagccgtgcgcatcaccaaggaacgcatctggggtcaggacgaggtcaatttcgttgagccggaagtcaaccgccaacttatcgccgaagccgttgaggctgccaaaactgctgacaccatcatcatggtcatcggcgacaacgagcagacctcacgcgaagcctgggccgacaaccaccttggcgaccgtcacaccctgcatctgatgggtgaacagatggaactggcccgtgcgatcttcgccctgaagaagccgaccgttaccttcctgctcaatggtcgtccgatgatcatcgaagaactggtcgaagggtctgacgccctgatcgaaggctggtacatgggtcaggaaaccggctatgcggccgctgatatcctgttcggtcgcgccaacccgggcggcaagcttccggtctcgttcccgcgcagcgaaggtcagcttccggtctattacaaccacaagcccacggcgcgccgcggctatcttgatggttcgaccaagcctctgttcccgttcggctatggcctcagctacaccaccttcgacatgtccgcaccgcgcctgtcgcaagccactattggcattgacggcagcgttgaagtctcggtcgatgtcaccaacaccggcgcccgcgcaggtgatgaagtggttcaggtctatatccgcgacgacttctcgtccgtcacccgtccggtgcttgagcttaagcacttcaagcgcgtgagcctgcaaccgggtgaaaagaagacggtgagcttcaccatcggcaagcaacagctccagttctacggcattgacatgaagcgtatcgtagagccgggcaccttcaccatctccgctggcccgaacagcgtcgatctgaagtctgtcacgttgaccgtggcctaa

SEQ ID NO: 494 - protein, 863 aa, Unknown
  Obtained from environmental sample
  DOMAIN (204)...(435): Glycosyl hydrolase family 3 N terminal domain
  DOMAIN (505)...(748): Glycosyl hydrolase family 3 C terminal domain
  SITE (336)...(339): N-glycosylation site. Prosite id = PS00001
MSHKTIRAFVQKFAVLALTAVPFPHDTHFIVSTYPNAVSQRMAILKTGSKPTMIHIKTPKLSRRLFGASSFALMLSAATHAAAQKAKMPKMPKLAKDAPLYKQPNAPINDRVEDLLGRMTLEEKVAQMQCIWQMKARVQDAQGNFDAKKASAEHPNGMGMLGRPSDRRMAAIDVAGAAAGDAGDIQNRNAYDTAVYVNAAQRWAVEDTRLGIPMMTHEESLHGYVARDATSFPQAIGLASSFDPEMAERIFSVCAREMRARGAFLALSPVVDIARDPRWGRIEETYGEDAHVNAEMGIAAVNGFTGRTLPLAKDKVFATLKHMTGHGEPQNGTNVGPAQVSERVLREDFFPPFERIIKETKIAAVMPSYNEIDGLPSHANRWLLTTILRGEWGFEGTTVSDYYAIRELIERHKLVPDLKEAAYRAVHAGVDVETADPSAYPFIPELIAEGRLTLDEVDGPVRRILREKFEAGLFENPYVDPNVADSLTGLPDAVALAHEAATKSVVLLKNNGLLPLVHNKVGKVLVLGTHAKDTPIGGYSDIPRHVVSILDGLEKEGKEHGFEVAYSEAVRITKERIWGQDEVNFVEPEVNRQLIAEAVEAAKTADTIIMVIGDNEQTSREAWADNHLGDRHTLHLMGEQMELARAIFALKKPTVTFLLNGRPMIIEELVEGSDALIEGWYMGQETGYAAADILFGRANPGGKLPVSFPRSEGQLPVYYNHKPTARRGYLDGSTKPLFPFGYGLSYTTFDMSAPRLSQATIGIDGSVEVSVDVTNTGARAGDEVVQVYIRDDFSSVTRPVLELKHFKRVSLQPGEKKTVSFTIGKQQLQFYGIDMKRIVEPGTFTISAGPNSVDLKSVTLTVA

SEQ ID NO: 495 - DNA, 972 bp, Unknown
  Obtained from environmental sample
atgaaaaaaccaagatacctggttaaggatttatacaccgctgatccttcggcgcacgtattcaacgggaagatttacatctacccctcacacgatgtagaatccggcattccggagaatgacctcggggatcatttcgacatgcgggattaccatgtattctccatggattcgatcgacggtgaggtgaccgaccacggggttgtcctggctgttaaggacatcccttgggcgggccgccagctctgggccccggatgccgccttcaaaaacggccaatattacctttatttcccgctgaaggataaaaatgatattttcagaataggtgtggcggtgagtgataagcccgaaggcccattcactcctcaaagtgatccgataaagggaagcttcagcattgatccggcggtattggacgacggtgacggaaacttttacatgtatttcgggggattgtggggaggacaacttcagcggtaccgcaacaacaaggccatagaatgcggtcacgaaccggccggtgatgaacccgctctgtgcgccagggtggcccgactgagagatgacatgctggaattcgccgaagaaccccgcgatgtggtcattttggatgaaaacggcgaaccactaagggctggcgatcacgacaggcgctactttgaagggccgtggatgcacaaatacaagggcaagtactatttctcctattcaaccggaaatacccactttctgtgttatgccacaggcgacagtccatatgggcctttcacctatcagggtgtgatcctcacaccggtgataggttggaccacccaccattcgattgtggaattccatgggaaatggtacctcttccaccacgacagtaagccatcggggggcaaaacctggcttcggagtataaaagtggttgagttggagtataatcccgacggaaccataaagactctggacggcctggctgactaa

SEQ ID NO: 496 - protein, 323 aa, Unknown
  Obtained from environmental sample
  DOMAIN (21)...(315): Glycosyl hydrolases family 43
MKKPRYLVKDLYTADPSAHVFNGKIYIYPSHDVESGIPENDLGDHFDMRDYHVFSMDSIDGEVTDHGVVLAVKDIPWAGRQLWAPDAAFKNGQYYLYFPLKDKNDIFRIGVAVSDKPEGPFTPQSDPIKGSFSIDPAVLDDGDGNFYMYFGGLWGGQLQRYRNNKAIECGHEPAGDEPALCARVARLRDDMLEFAEEPRDVVILDENGEPLRAGDHDRRYFEGPWMHKYKGKYYFSYSTGNTHFLCYATGDSPYGPFTYQGVILTPVIGWTTHHSIVEFHGKWYLFHHDSKPSGGKTWLRSIKVVELEYNPDGTIKTLDGLAD

SEQ ID NO: 497 - DNA, 1572 bp, Unknown
  Obtained from environmental sample
atgaccctagccaatccggttctttccgggttcaaccccgatccgtccattctgcgggtcggtgatgattactacattgccacgtccacctttgagtggtttcccggagtgcagatactgcactccagggacctggtgcattggcgacagatcgcctttccgctgaatcgctactcgcaactggatttgcgcggtcatcccaactccgccggagtctgggcgccgtgtctgagctacagcgacgggctcttctatctgatctttaccgacacgcgcagctggaccggagccttcaaggatacgcacaactatctggtaaccgcgccggcgattaccggcccctggtccgaaccggtgtacctgaacagttccggttttgatccctccctgtttcacgacgacgatggccgcaagtggctggtcaacatggtgtgggaccaccggccggagcgaccgcacttcggtggcatactgttacaggagtacgacccggagcagcagcgtctgacggggccggtgcgcaacatctttcgcggtaccgaactgggattggtggaaggcccgcatctgtacaaggtggacggctactattacctgctgaccgccgagggtggtacctttctcactcacgccgccactgtggcacggtcccgggacatcggcggtccctatgaagtgatgcccggcaatccgctgatcaccagcgcccatcgacctgaactgcggctcaagtccgccggtcacggctcgctggtacagcatcgcgatggcagttggagcctggcgcatctgtgtcgccgccacctgcccaatggccgcgccattctcgggcgggagacggccctgcagaatatcgagtgggtggatggctggccgcgactggcgtccggcgatgtggtgccgctggatgagttccagccgccgccactgccgccacatccctggccacccgaaccggcccgggatgatttcgatgcgccggaactggcgctgtgctggcaggcgcccagagtcgcgctggacgggcagatgctcagcctgagtgagcggccagggcacttgcgtctgtttggccgcgagagcccgcgctcgcactttgaacagagtctggtggcgcggcggcagcaggcgtttcatattgaggcgtccacctgtctgcgtttcgagccggagcattttcagcagatggccggtctgatggcctactacaacaccgataatttctattacctgtttgtctcccggtccgagcatgcacagaagtgtctgggcttgatgcgctgtgaacagggtcaggtttcctggcccattgaaaaggaatacccgctggacaattgggagagcatctacctgaaactggtgatcgaccaccagcgcatcaatttctactattcaccggacggcgaacactggacgattgccgggtttgagcaggacgcgtcgatactgtccgatgaacacgccgtgcctctgggttttaccggaaactttgtcggtatggcgtgtcaggatctgtcgggtacccgcagggcggccgacttcgattggtttgaatatcgggagatggggtaa

SEQ ID NO: 498 - protein, 523 aa, Unknown
  Obtained from environmental sample
  DOMAIN (3)...(292): Glycosyl hydrolases family 43
  SITE (123)...(126): N-glycosylation site. Prosite id = PS00001
MTLANPVLSGFNPDPSILRVGDDYYIATSTFEWFPGVQILHSRDLVHWRQIAFPLNRYSQLDLRGHPNSAGVWAPCLSYSDGLFYLIFTDTRSWTGAFKDTHNYLVTAPAITGPWSEPVYLNSSGFDPSLFHDDDGRKWLVNMVWDHRPERPHFGGILLQEYDPEQQRLTGPVRNIFRGTELGLVEGPHLYKVDGYYYLLTAEGGTFLTHAATVARSRDIGGPYEVMPGNPLITSAHRPELRLKSAGHGSLVQHRDGSWSLAHLCRRHLPNGRAILGRETALQNIEWVDGWPRLASGDVVPLDEFQPPPLPPHPWPPEPARDDFDAPELALCWQAPRVALDGQMLSLSERPGHLRLFGRESPRSHFEQSLVARRQQAFHIEASTCLRFEPEHFQQMAGLMAYYNTDNFYYLFVSRSEHAQKCLGLMRCEQGQVSWPIEKEYPLDNWESIYLKLVIDHQRINFYYSPDGEHWTIAGFEQDASILSDEHAVPLGFTGNFVGMACQDLSGTRRAADFDWFEYREMG

SEQ ID NO: 499 - DNA, 2358 bp, Unknown
  Obtained from environmental sample
atgaagaagagagcttttagctttagtctttgtgttgccattatttcgactttctggttgcctgttgcacacatgagctcgcaagacaatcagccggactacaaaaacccgcgtcttccggtcgataggcgcgtcgcggacttgctgtcgcgcatgacgctcgaagaaaaagtggcgcagttggtctgtctctggggtagccggccgcaagttaatccgcaaaccaatttcgccaccgatcgcggtgacttttctcccgcaaaagcggcggaagtcatgaagcacggcatcggccagatcgcgcgccaacgagaacgtaaagatccgcgccagggcgcgacgttcgccaacgcggtgcagaagtggttgatcgaaaacacgcggctcggaatcccagcgattcttcacgacgagatacttcacggccatatggccaaaggcagcacgagcttcccgcagccgatcgcactcgctacaacctgggacccggacttcatcacgaaagtctttacggcgggcgcgctcgagacgcgggcgcgcggaagtcatcaagtgcttggtccaaacctcgacctggcccgcgacgctcgctggggacgaactgaagagacctacggcgaagatccctatctcacgtcgcgcatggccgtcgcgatcgtgcgcgctttgcagggacccggaccgggtgtcgacggcgatcacgtcatcgccacggccaaacactttgcggcccacggccaaccggagagcggcaccaacatcgcgcccgtaaatttttcagaacgaacgttgcgcgaatacttcctgccgagcttcaaagcggcggtgactgaggccggcatcatgagcgtgatgccttcgtacaacgagatcgacggcgtgccgtctcacgctaacaagtggctgttgcaagacctcctgcgcgaagaatggggcttcgacggtcacgtcgtctccgactactacgcgattccgcaaatgatggatctgcatcgcatcgccggtgataaagcagcgactgcgaagctcgcaatcgaggccggcgtcgacaccgaacttccggatcctgattcgttcccgactctcttgcgcttggtgaaagagggacaggtctcggaagcgacgctcaatcgagcggtcgcgcgtaacctgcgcgcgaagtttctgctcggattgtttgagaacccgtacgtcgacgtcgaacgtgctgtgcggatcacgaactcgagcgaacaccgggcgttggcggctgaagcggcgcgcagatcgatcacgctgctgaagaaccaaaacaacctgctgccgttgaaccgaaacactctgaaatcgatcgcggtgattggcccaaacgccgcgcaggtccatctcggcggatacagtgatcagccaggccgcggcgtcagtgtggtccagggtatcaaagacaaggtaggcggctcgatcaaggtcgcgtacgccgaaggctgcaagataaccaaagaaggcggcgattggttcgccgataccgctactctcagcgatccggctgaggatcgaaagttgatcgccgaagctgtgcaagtggcaaagacagccgacgttgcgctgctcgtactcggcggcaacgaagacacgaacaaagaaggctgggccgacaatcatctcggcgatcgcgatagtctcgagttgatcgggcggcaaaacgatctcgtcaaggccattctcgagaccgggaaaccgaccatagttctgcttatcaacagcggtccgctttcgatcaactacatcgccgaaaacgttcctgcgattctcgaaggtttctatctagggcaggaaacaggcgtcggcgtcgccgatgtcctgttcggcgacttcaacccggcgggcaaactgacgatcagttttccacgatcagtcggacagttgccgctctactacaaccgcaagccaaccgcgcgccgcggctatctgtttgcaaacaaggagccgttgtttccattcggatttgggcttagctacacgacgttcgcctattccgatctaaaagttactccggcgaagataggcgtcgcgggtgaggcgcgggtcagcgtcacggtcaggaacagcgggagccgtgcgggcgacgaggtcgtgcaactctacattcgcgaccttgtgagttcggttacacggcccatcatggagttgaaagacttcaagcgcatcccgctggcgccgggcgagagtaagaccgtcgagtttgtcatcacgcccgaaaaactttctcttctggatctgaatatgaaaagcgtggtcgagcctggatggttcgatatcatggtcggaacaagctcagtaaaatatgagacagtcaaacttgaggttgcggcgaagtag

SEQ ID NO: 500 - protein, 785 aa, Unknown
  Obtained from environmental sample
  SIGNAL (1)...(25)
  DOMAIN (123)...(354): Glycosyl hydrolase family 3 N terminal domain
  DOMAIN (424)...(668): Glycosyl hydrolase family 3 C terminal domain
  SITE (261)...(264): N-glycosylation site. Prosite id = PS00001
  SITE (414)...(417): N-glycosylation site. Prosite id = PS00001
MKKRAFSFSLCVAIISTFWLPVAHMSSQDNQPDYKNPRLPVDRRVADLLSRMTLEEKVAQLVCLWGSRPQVNPQTNFATDRGDFSPAKAAEVMKHGIGQIARQRERKDPRQGATFANAVQKWLIENTRLGIPAILHDEILHGHMAKGSTSFPQPIALATTWDPDFITKVFTAGALETRARGSHQVLGPNLDLARDARWGRTEETYGEDPYLTSRMAVAIVRALQGPGPGVDGDHVIATAKHFAAHGQPESGTNIAPVNFSERTLREYFLPSFKAAVTEAGIMSVMPSYNEIDGVPSHANKWLLQDLLREEWGFDGHVVSDYYAIPQMMDLHRIAGDKAATAKLAIEAGVDTELPDPDSFPTLLRLVKEGQVSEATLNRAVARNLRAKFLLGLFENPYVDVERAVRITNSSEHRALAAEAARRSITLLKNQNNLLPLNRNTLKSIAVIGPNAAQVHLGGYSDQPGRGVSVVQGIKDKVGGSIKVAYAEGCKITKEGGDWFADTATLSDPAEDRKLIAEAVQVAKTADVALLVLGGNEDTNKEGWADNHLGDRDSLELIGRQNDLVKAILETGKPTIVLLINSGPLSINYIAENVPAILEGFYLGQETGVGVADVLFGDFNPAGKLTISFPRSVGQLPLYYNRKPTARRGYLFANKEPLFPFGFGLSYTTFAYSDLKVTPAKIGVAGEARVSVTVRNSGSRAGDEVVQLYIRDLVSSVTRPIMELKDFKRIPLAPGESKTVEFVITPEKLSLLDLNMKSVVEPGWFDIMVGTSSVKYETVKLEVAAK

SEQ ID NO: 501 - DNA, 972 bp, Unknown
  Obtained from environmental sample
atgaagatacccaaatatttagttccaaacgattatatggccgatccggccgtacatgtatttaatgacaggctttatatttacccatctcatgaccgtgagagtggtattgaagagaatgataacggtgatcatttcgatatgaaagattatcatgtattctcgacggatgatctagagaatggtactctcatcgatcatggagttgtcttggatacaaaaaatattccgtgggcaggtcgtcaactttgggattgcgacgtggcatataaagatggtaaatattatctctactttccgctgaaagatcaaacggacatttttcggattggagttgctgtcagcgataaacctgagggtccatttattcctgaagataatccaatcaaggggagctacagcatagatccggcaatattgaatgatggcggcggcaattattacatgtatttcggtggtttgtggggtggtcaacttcaacgctaccgtaataacaaagctttggaatgtgcggtattgcctgaaaatgatgaattggcactcaattctttggtagttaaactcagcgacgatatgttggagtttgcggaagaaccgaaggcagtcattattcttgatgaaaagggcgaacccttgaaagccggtgattccgaacgccgtttctttgaggcctcttgggttcataaatacaatggaaaatactatttttcttattctaccggagatacacatctgctctgttatgctgtgggtgatcatccatatggcccgttcacttatcagggcgtgatccttactcctgtagttggctggacgactcatcatgccatcgtagaatttaaaaataaatggtatctattctttcacgattgtgtgccgtcaggaggacgaacttggttgagaagtctgaaagtggttgaactagaatatgatgattcgggtaaaataaaaacgatcgagggtactttataa

SEQ ID NO: 502 - protein, 323 aa, Unknown
  Obtained from environmental sample
  DOMAIN (13)...(316): Glycosyl hydrolases family 43
  SITE (61)...(64): N-glycosylation site. Prosite id = PS00001
MKIPKYLVPNDYMADPAVHVFNDRLYIYPSHDRESGIEENDNGDHFDMKDYHVFSTDDLENGTLIDHGVVLDTKNIPWAGRQLWDCDVAYKDGKYYLYFPLKDQTDIFRIGVAVSDKPEGPFIPEDNPIKGSYSIDPAILNDGGGNYYMYFGGLWGGQLQRYRNNKALECAVLPENDELALNSLVVKLSDDMLEFAEEPKAVIILDEKGEPLKAGDSERRFFEASWVHKYNGKYYFSYSTGDTHLLCYAVGDHPYGPFTYQGVILTPVVGWTTHHAIVEFKNKWYLFFHDCVPSGGRTWLRSLKVVELEYDDSGKIKTIEGTL

SEQ ID NO: 503 - DNA, 966 bp, Unknown
  Obtained from environmental sample
atgaaaaaagcaaaatatcttttcccgaatgactatatggcagatccttctgcgcacgtttttgaaggaaaaatctacatatatccctctcacgaccgagaaagcggaattgaagaaaatgacaacggcgatcattttgacatgaatgattaccatgtattttctcttgacgatgttgaaaatggagatatcaccgatcacggggtagtgctttccgtcaaggatattccgtggtcaggacgccaactttgggactgtgacgtggcagaaaaaaacggaaaatattatatgtattatccgctaaaagataaaacggatattttcagaatcggagtggcagtaggcgaaaaaccttacgggcctttcatccctgagaaacatccgattttaggaagctacagcattgatccttgtgtgtttgatgacaatggaacgcattatctgtatttcggaggaatctggggaggacaattacaacgttaccgtgagaataaagcattggaatgtgctgttattcctgaaaatgacgagcctgccatttcttcaaaagtagttcggctgagtgacgatatgcttgaatttgcggaggaacccaaagacttaaaaattcttgacgaaaacggaaacgaacttctgcacggagatccgcaccgtttttttgaagcatcttggatgcataagtacaacggaaaatattacttctcatattcaacgggagacacgcatcttctctgttacgcagtgggagacaatccttacggacctttcactttcaaaggggaaattttaacacctgttgtcggttggacaacgcatcacagtattgttgaattcaaaggaaaatggtatttgttcttccacgattctgtaccaagtggcggaagaacctggctaagaagtatgaaagtagtagaacttgagtacaataacgatggtaccatcaaaactattgagggggaagaatag

SEQ ID NO: 504 - protein, 321 aa, Unknown
  Obtained from environmental sample
  DOMAIN (6)...(314): Glycosyl hydrolases family 43
  SITE (145)...(148): N-glycosylation site. Prosite id = PS00001
MKKAKYLFPNDYMADPSAHVFEGKIYIYPSHDRESGIEENDNGDHFDMNDYHVFSLDDVENGDITDHGVVLSVKDIPWSGRQLWDCDVAEKNGKYYMYYPLKDKTDIFRIGVAVGEKPYGPFIPEKHPILGSYSIDPCVFDDNGTHYLYFGGIWGGQLQRYRENKALECAVIPENDEPAISSKVVRLSDDMLEFAEEPKDLKILDENGNELLHGDPHRFFEASWMHKYNGKYYFSYSTGDTHLLCYAVGDNPYGPFTFKGEILTPVVGWTTHHSIVEFKGKWYLFFHDSVPSGGRTWLRSMKVVELEYNNDGTIKTIEGEE

SEQ ID NO: 505 - DNA, 975 bp, Unknown
  Obtained from environmental sample
atgaagaagccaagatatcttgtagaccatctatacacagccgacccttcggcccatgttttcaatggaaaattatacatctatccatcgcacgatgttgaatcaggaattcccgagaatgacaacggcgaccattttgatatgcgcgattaccacgtgttttcgatggacgatattgatgggcctgttactgatcatggtgttgctttggatgttaaaaatattccctggtcgggtcgtcagttatgggcacccgatgcagcctgcaaaaacggtaaatactatctttattttcccttaaaggataaaaacgacattttccgtattggcgttgctgtgagcgataagcccgaaggtccgtttattccacaggagaacccaattaaaggaagtttcagcatcgaccctgctgttttagaggacaatgatggtaaatactatatgtattttggcggactatggggcggtcagcttcaaagataccgcaacaataaagccatagagtgcggtcatgaacctgctgataacgaacctgctttgtgtgctaaagttgctgtgttaagcgatgacatgctggagtttggtgaagaaccccgcgatgtggttattctcgacgaaaaaggagaaccattgaaagccggcgaccacgatcgtcgttattttgaaggcccatggatgcacaaatacaaaggaaaatactacttctcctactccaccggcaatacacataaactttgctatgccgttggcgatagcccttatggccctttcacctataaaggagttattctaaccccggtggtaggttggactacacatcactctatatgcgagtttaaaggtaaatggtatctcttccaccacgacagtgttccttcaggaggcaaaacctggttaagaagcattaaagttgttgagttggaaatgaatgacgatggcactattgttaccatggaaggtggtggcaactggtag

SEQ ID NO: 506 - protein, 324 aa, Unknown
  Obtained from environmental sample
  DOMAIN (4)...(315): Glycosyl hydrolases family 43
MKKPRYLVDHLYTADPSAHVFNGKLYIYPSHDVESGIPENDNGDHFDMRDYHVFSMDDIDGPVTDHGVALDVKNIPWSGRQLWAPDAACKNGKYYLYFPLKDKNDIFRIGVAVSDKPEGPFIPQENPIKGSFSIDPAVLEDNDGKYYMYFGGLWGGQLQRYRNNKAIECGHEPADNEPALCAKVAVLSDDMLEFGEEPRDVVILDEKGEPLKAGDHDRRYFEGPWMHKYKGKYYFSYSTGNTHKLCYAVGDSPYGPFTYKGVILTPVVGWTTHHSICEFKGKWYLFHHDSVPSGGKTWLRSIKVVELEMNDDGTIVTMEGGGNW

SEQ ID NO: 507 - DNA, 1440 bp, Unknown
  Obtained from environmental sample
atgcaaaatcgtcgagaatttttacaacttttatttgccggtgccggtgccggacttgttttgccgcagatttctttcgggcagactaaacaagccgacgcctggacgaccgagtatccgaagattttagccagaatcaaaccgccgaaatttcgcaaaaaagattttccgatcaccaaatatggagccgttgcggacgggaaaaccctggcgaccgaaagcatcaaaaaagccatcgaagcgtgcgccaaatcgggcggcgggcgcgtcgtcgtgccccagggagaatttttgaccggcgcgattcatttgaaatcaaacgtcaatctgcacatcacgaaaggcgcgaccgtcaaattttccaccaacccgaaagattatctgccgatcgttcacacgcgctgggaagggatggaattgatgcatatttcgcctttaatttatgcctacgagcaaaccaacatcgccgtcaccggcgagggaacgctcgacgggcagggcaaggcttttttctggaaatggcacggaaacccgcgctacggcggaaatccggatgtgatcagccagcgtccggcgcgcgcccggctgtatgaaatgatggaaaaaggcgtgcctgtggcggagcggattttcggcgaaactcagtatcttcgcccgcagtttatccagccctataaatgcaaaaatgttttgatcgaaggcgttaaaatcatcgattcgccgatgtgggaagttcaccccgttttgtgcgaaaacgtgacgatccgaaaacttcatatttctacccacggaccgaacaacgacgggtgcgatccggaaagctgcaaggacgttttgatcgaagactgctatttcgacaccggcgacgattgcattgccatcaaggcggggcgcaatgaagacgggcgacgcatcaatgttccgaccgaaaacgtcgtcgtgcgcgggtgcgtgatgaaggacggtcacggcggaatcaccatcggaagcgagatttccggcggcgtgcgaaatgttttcgcggaaaacaaccggctcgacagcgcggatttgtggactgcgctgagagtgaaaaacaacgcttcgcgcggcggaaaactggagaatttttacttccgcgatatcaccgtcgggcaggtctcgcgcgcggtcgtcgaaatagattttaattacgaggaaggcgctaaaggaaaacacacgccggtcgttcgcaattacgtggtcgaaaatctaacctgcaataaaggcaatcgagcggtcgatctgcagggcttggacaacgccccgatttacgacatcacgatgaaaaactgtacgtttaacgtggtcgaaaagccgagcgtcgtgaaaaacgtcaaaggcgtcaaactggaaaacgtgaagattaacggcaaagtcgtcgagagtctggaaaatgctgcaacgacggctaaaaaataa

SEQ ID NO: 508 - protein, 479 aa, Unknown
  Obtained from environmental sample
  SIGNAL (1)...(27)
  DOMAIN (82)...(461): Glycosyl hydrolases family 28
  SITE (255)...(258): N-glycosylation site. Prosite id = PS00001
  SITE (365)...(368): N-glycosylation site. Prosite id = PS00001
  SITE (416)...(419): N-glycosylation site. Prosite id = PS00001
  SITE (443)...(446): N-glycosylation site. Prosite id = PS00001
MQNRREFLQLLFAGAGAGLVLPQISFGQTKQADAWTTEYPKILARIKPPKFRKKDFPITKYGAVADGKTLATESIKKAIEACAKSGGGRVVVPQGEFLTGAIHLKSNVNLHITKGATVKFSTNPKDYLPIVHTRWEGMELMHISPLIYAYEQTNIAVTGEGTLDGQGKAFFWKWHGNPRYGGNPDVISQRPARARLYEMMEKGVPVAERIFGETQYLRPQFIQPYKCKNVLIEGVKIIDSPMWEVHPVLCENVTIRKLHISTHGPNNDGCDPESCKDVLIEDCYFDTGDDCIAIKAGRNEDGRRINVPTENVVVRGCVMKDGHGGITIGSEISGGVRNVFAENNRLDSADLWTALRVKNNASRGGKLENFYFRDITVGQVSRAVVEIDFNYEEGAKGKHTPVVRNYVVENLTCNKGNRAVDLQGLDNAPIYDITMKNCTFNVVEKPSVVKNVKGVKLENVKINGKVVESLENAATTAKK

SEQ ID NO: 509 - DNA, 1377 bp, Unknown
  Obtained from environmental sample
atgacgacgcgacgcgaattcattcgagatcttttggttggcggcgtagtggtcgctgttgcaccgcgtttcctggcgttttcttcggtggcgagtccgtgggaaacggtgatgccttcgatcctcgaacgcatcaagccaccgcgttttccgaaacgcacgtgctatctcaaccggtttggagcaaaaggcgacgggcaaactgattgcacttcagcttttcgacgcgcaatcgatcagtgttcgaaagcgggcggtggcaaagtgatcgttccgcagggaatgtatctcaccggcgcaattcacttgaagagcaacgtcaatctcgagatctccgaaggcgcgacgatcaagttcagtcaaaacccgaaagactatctcccggtggttttttcgcgttgggaaggcgtcgaagtattcaactactcacctttcatctacgcatttgaacagcagaacatcgcgatcacgggcaagggcacgctcgatgggcagagtgataacgaacactggtggccatggaacggacgcgccaggtacggttggaaagaagggatgagccaccagcgtccggatcgaaacgcgctctttgcgatggcggaaaaaggtgtttcggttcgcgaacgtgttttcggcgagggtcattacttaaggccgcagttcattcagccgtatcgctgccagaacgtattgatcgacggagttacgatacgaaactcgccgatgtgggaaattcatccggtgctgtgccggaatgtcatcgtgcaaaacgtgcacattaacagtcatggaccaaacaacgatggctgcaatcccgagtcgtgcactgatgtgctgattaagaactgttacttcgacactggcgacgactgtatcgcggtcaaatcaggacgcaacgcggacggccggcggcttaaagcgccgacagagaacgtgatcgtgcaagactgtcaaatgaaagatggacacggcgggatcactgtcggcagtgagatctcaggcggtgtgagaaatctgtttgcggagaactgccggcttgatagtccaaacctggaccatgctttgcgggttaagaacaacgcgatgcgtggagggctgctcgagaatttgcacttccgaaacatcgaagttggtcaggtggcgcatgcagtgatcacgatcgattttaattacgaggaaggcgcgaaaggatcgttcacgccggtggttcgtgactacactgtcgatggtttgcgcagcacgcgaagcaaatacgcgctcgacgttcaaggtctgtcgggcgcgccgatcgtaaatctgcgtctgacgaattgcacgttcgacaatgttgccgaagggaacgtcgtgaagaatgttaaggacgcgacaattcaaaaa

SEQ ID NO: 510 - protein, 459 aa, Unknown
  Obtained from environmental sample
  SIGNAL (1)...(31)
  DOMAIN (81)...(458): Glycosyl hydrolases family 28
  SITE (443)...(446): N-glycosylation site. Prosite id = PS00001
MTTRREFIRDLLVGGVVVAVAPRFLAFSSVASPWETVMPSILERIKPPRFPKRTCYLNRFGAKGDGQTDCTSAFRRAIDQCSKAGGGKVIVPQGMYLTGAIHLKSNVNLEISEGATIKFSQNPKDYLPVVFSRWEGVEVFNYSPFIYAFEQQNIAITGKGTLDGQSDNEHWWPWNGRARYGWKEGMSHQRPDRNALFAMAEKGVSVRERVFGEGHYLRPQFIQPYRCQNVLIDGVTIRNSPMWEIHPVLCRNVIVQNVHINSHGPNNDGCNPESCTDVLIKNCYFDTGDDCIAVKSGRNADGRRLKAPTENVIVQDCQMKDGHGGITVGSEISGGVRNLFAENCRLDSPNLDHALRVKNNAMRGGLLENLHFRNIEVGQVAHAVITIDFNYEEGAKGSFTPVVRDYTVDGLRSTRSKYALDVQGLSGAPIVNLRLTNCTFDNVAEGNVVKNVKDATIQK

SEQ ID NO: 511 - DNA, 1398 bp, Unknown
  Obtained from environmental sample
atgattaaccgtcgagatttcataaaagacctcatcatcacctccgccggagtcgcggttctcccgcaactggcgttcggacaaaacgatccctggaaaactcaatacccgcagatcctcgcgcggatcaaaccgccgaaatttccgaagcgcgatttcgtcatcacgaagttcggcgcgaaggcgggaaccgatagcacgcaagcgatcgctaaagccctcgacgcttgcgcgaaagccggcggcggacgcgtcgtcgtacccgccggcgaatttctcaccggtgcgatccatctcaagtcgaacaccaatctctacgtctcaaaaggcgcgactctgaagttttcgaccgaccccgaaaaatatctgccgatcgttcacacgcggtgggaagggatggagttgatgcatctctcgccgttcatctacgcgtacgagcagacgaacatcgcgatcaccggcgagggcacgctcgacggccaaggcaaatcgttcttttggaagtggcacggcaacccgcgatacggcggcaaccccgaagtgatcagtcagcaaaaagcgcgggcgcgactttacgagatgatggacaagaacgtacccgtcgcggagcgcgtgttcggtatcgggcactatctccggccgcagttcatccagccgtacaaatgtaagaacgtcttgatcgaaggcgtgacgatcatcgactcgccgatgtgggaagttcatccggtgctttgcgagaatgtcaccgtccgcaatcttcacatctcgtcgcacggtccgaacaacgacggctgcgatcccgagtcgtgcaaagacgtcctgatcgacaactgcttcttcgacaccggtgacgactgcatcgcgatcaagtcgggtcgcaataacgacggtcgtcgtctgaacacaccgaccgagaacatcatcgtccgcaactgcacgatgaaagacggtcacggtggtatcacggtcggaagcgagatctcgggcggcgtgcgaaacttgttcgcacacgattgcaagatggacagtgcggatctgtggaccgcgctccgggtaaagaacaacgcatcgcggggcggcatgctggagaatttctatttccgcaacatcaccgtcgggcaagtcgcgcgtgctgtggtcgagatcgatttcaactatgaagaaggcgcgaagggatcgtacacaccggtcatgcgcaactacgtggtcgaggatctgacgtgcaccagcgggaaccggcccgtcgatctgcaaggattagacaacgcgccaatttacgatgtgtcgctgcgtaacacgaccttcggcgcgatgaagaacaagagcgtcgtgaagaatgtccgaggactgaagatcgaaaacgttaccgtcagcggcacgcgcgtggagagtttatga

SEQ ID NO: 512 - protein, 465 aa, Unknown
  Obtained from environmental sample
  SIGNAL (1)...(27)
  DOMAIN (77)...(459): Glycosyl hydrolases family 28
  SITE (250)...(253): N-glycosylation site. Prosite id = PS00001
  SITE (315)...(318): N-glycosylation site. Prosite id = PS00001
  SITE (315)...(329): Polygalacturonase active site. Prosite id = PS00502
  SITE (360)...(363): N-glycosylation site. Prosite id = PS00001
  SITE (374)...(377): N-glycosylation site. Prosite id = PS00001
  SITE (438)...(441): N-glycosylation site. Prosite id = PS00001
  SITE (446)...(449): N-glycosylation site. Prosite id = PS00001
MINRRDFIKDLIITSAGVAVLPQLAFGQNDPWKTQYPQILARIKPPKFPKRDFVITKFGAKAGTDSTQAIAKALDACAKAGGGRVVVPAGEFLTGAIHLKSNTNLYVSKGATLKFSTDPEKYLPIVHTRWEGMELMHLSPFIYAYEQTNIAITGEGTLDGQGKSFFWKWHGNPRYGGNPEVISQQKARARLYEMMDKNVPVAERVFGIGHYLRPQFIQPYKCKNVLIEGVTIIDSPMWEVHPVLCENVTVRNLHISSHGPNNDGCDPESCKDVLIDNCFFDTGDDCIAIKSGRNNDGRRLNTPTENIIVRNCTMKDGHGGITVGSEISGGVRNLFAHDCKMDSADLWTALRVKNNASRGGMLENFYFRNITVGQVARAVVEIDFNYEEGAKGSYTPVMRNYVVEDLTCTSGNRPVDLQGLDNAPIYDVSLRNTTFGAMKNKSVVKNVRGLKIENVTVSGTRVESL

SEQ ID NO: 513 - DNA, 1416 bp, Unknown
  Obtained from environmental sample
atgtcgtcacgacgcgagttcattagagatctgttgactggcggcgcactgatcgccgtcgcgccgcgtctgtctgcgtttgcagcggaggagaatccgtgggaaacggtgatgccttcgatcgtgaaacgcatcaagcgacctcgtttcccgatgcgcacgtttgatctcacggagtttggagcgaaaggtgatggacgaacagattgcacgttggctttccgtcgcgcgatcgatcgatgcacgaacgccggtggtgggagagtagttgttccaccgggttcgtatctcactggcgccattcatttgaagagcaacgtcgaccttcatatctcagaaggtactacggtcaagttcagccagaacccgaaagactacctgcccgttgttttctcgcgttgggaaggcgtcgaggtgttcaactactcgccttttatctacgccttcgaacaaacgaacattgcgatcactggcaagggcacgctcaacggtcaaagcgacaacgaacactggtggccctggaacggacgtgccgcgtacggctggaaagaagggatgagcaatcagcgtcccgatcgaaatgcgctgtttgcgatggccgaaaaaggtgtcccggttcaggagcgcatttttggtgagggccattacttaaggccgcagttcattcaaccttatcgttgtgagaacgtgctgatcgaaggtgtcactattcgaaactcgccgatgtgggaaattcatccggtgctctgccggaatgtcatcgtccaaaatgtgatcatcaacagtcatggtccaaacaacgacgggtgtaatcctgagtcgtgcacggatgtgttgattaaggattgtgacttcgacactggtgacgattgtatcgcgatcaagtcaggccgaaatgcagatgggcggcgactgaaggctcctactgaaaacattatcgtgactggttgtcgcatgaaagatggtcacggcgggattacggtgggcagcgagatttcgggtggggtgcgaaatcttttcgcatccaactgccggctcgacagtccgaacctggaccatgcattgcgggttaagaataacgctatgcgtggcgggctgttggagaatctgcacttccgaaatatcgacgtcgggcaagtggcgcacgcggtgatcacgatcgatttcaattatgaggaaggcgcgaagggatcgttcacgccagtcgttcgtgattacaccgtcgatggccttcgcagcacgaaaagtaagtacgcgctcgatgtgcagggcttggcgacggcgccgatcgtgaatctgcgtctaaccaactgcatcttcgacaatgtcgctgaaggaaatgttgtgaagaacgtaaaggatgcaactatcgagaatgtcaaaatcaatggaaaaagcgttgatgcagtgccgtag

SEQ ID NO: 514 - protein, 471 aa, Unknown
  Obtained from environmental sample
MSSRREFIRDLLTGGALIAVAPRLSAFAAEENPWETVMPSIVKRIKRPRFPMRTFDLTEFGAKGDGRTDCTLAFRRAIDRCTNAGGGRVVVPPGSYLTGAIHLKSNVDLHISEGTTVKFSQNPKDYLPVVFSRWEGVEVFNYSPFIYAFEQTNIAITGKGTLNGQSDNEHWWPWNGRAAYGWKEGMSNQRPDRNALFAMAEKGVPVQERIFGEGHYLRPQFIQPYRCENVLIEGVTIRNSPMWEIHPVLCRNVIVQNVIINSHGPNNDGCNPESCTDVLIKDCDFDTGDDCIAIKSGRNADGRRLKAPTENIIVTGCRMKDGHGGITVGSEISGGVRNLFASNCRLDSPNLDHALRVKNNAMRGGLLENLHFRNIDVGQVAHAVITIDFNYEEGAKGSFTPVVRDYTVDGLRSTKSKYALDVQGLATAPIVNLRLTNCIFDNVAEGNVVKNVKDATIENVKINGKSVDAVP

SEQ ID NO: 515 - DNA, 2160 bp, Cochliobolus heterostrophus
  misc_feature: Cochliobolus heterostrophus ATCC 48331 DNA
atccctttcgatcagcgtgcttcgaaacgtgcagtgggcagttgggatgatgcatatacaaaggcaacagcagcactcgcaaagctatcgcaagatgaaaagattggaatcgtcacgggaactggctggtcgaagagtaattgtgtaggcaacaccaagcctgctagctcgattggataccccgagctatgtctgcaagatggtccccttggtgtccgctatgtccggggtataaccgcctttgcagctggcatccatgctgccagcacttgggacatcgatctcatccgtgaaagaggtgcttttctcggcaacgaagcaaaacaattgggtatccacgtacagctaggtccgtctgctggtccccttggcaagtttgccaagggcggccgtaactgggagggatttggatcagatccttatctccaaggcatcatgatggcacagaccattgagggcatgcaagaagctggtgttcaggccactgctaagcattggattgtgaatgaacaagagctcaaccgagacactatgagctctgatgtgagcgatagggtcctgcgcgagttgtatgtttggccattcgcggacgccgctcacagcaaggttgcggcattcatgtgcagctacaacaagctcaactcaacatgggcgtgtgaaagcgaaggcgttatgcaaaaactcttgaaagacgagcttggccaccgtggatacatcatgtcggattggaatgcgcaacacactacgactggcagtgcaaatggtggcatggacatgaccatgcccggcagtgattttagtggcggaaacgtgctctgggggccgcaactcaagacagccattagcaacggtcaagttcagcaatcacgcctcgatgatatggtcaagcgagtccttgctgcgtggtaccttatgggccaggacaagggttatcctgcgacttccttcaactcctggaacattggaacaaaacaaatcagtggaaaccacgggactaatgtccgagcgactgctcgagacggcactatcctgctgaagaatgctaatggtgcgctacccctgaagaagccaaagagcattgctgtcattggaactgacagtattgtcgcacctcgcggggccaatgcttgtgtcgaccgtggatgcaccgaaggtgttcttaccatgggctggggttcgggatcagttgagcttccatccaatatggtcgcgccactggatgccatcaagacgcaggcccaaaaagacggtacgacggttacttcgtcgcccaccgacaatgcccagcaaggcgccagcgcagctcaaaatgctgagattgccgtggtatgcatcaacagcaacgctggtgaaggctacatcaatgtggaaggcaacgctggcgaccgaaataacctagacccctggcacaatggcaatgagcttgtcaaggcggttgctgccgtgaacaagaagacggtggttgtcgttcacagcgttggaccaatcatcatggagcagtggattgagaatcccaacgtcgttgcagtagtgtgggcaggtctcccaggccaagagcccggcaacggcgttgtcgacatcatgtatggcgcagcgtcgccaagcggcaagcttccttacaccattgcgaagaaagagtctgactacggcaccacaattgccagtggcgatgacaagtcctgggatctgtacatcgactatcgctatttcgacaagcagaacatcacacccaggtttgaatttggctttggactctcatacaccaacttcacctactcagagctcaccgtaactggcaagccttctgctggtcctgcgactggtgctgtaggacctggaggccccgttgatctcttcgagactgtcgctacagtcaccgccaagattgccaactctggtggtgttgctggtgccgaggtaccgcagctgtatctgggctaccctgcgtctaccaactctccaccaaaacaactcaggggcttcagcaagctcaagttggaggctggtgctagcggaaccgcaacattcaagctgaggaggagggacatgagtttctgggacgagaagaccaggaagtggactgttgcgacgggcgagtacactgtctttgtcggagcaagctccagggacgtgaggctgacgggcaagattgttgtgtaa

SEQ ID NO: 516 - protein, 719 aa, Cochliobolus heterostrophus
  DOMAIN (1)...(719): Cochliobolus heterostrophus ATCC 48331 protein
  DOMAIN (52)...(262): Glycosyl hydrolase family 3 N terminal domain
  DOMAIN (342)...(589): Glycosyl hydrolase family 3 C terminal domain
  SITE (217)...(220): N-glycosylation site. Prosite id = PS00001
  SITE (598)...(601): N-glycosylation site. Prosite id = PS00001
IPFDQRASKRAVGSWDDAYTKATAALAKLSQDEKIGIVTGTGWSKSNCVGNTKPASSIGYPELCLQDGPLGVRYVRGITAFAAGIHAASTWDIDLIRERGAFLGNEAKQLGIHVQLGPSAGPLGKFAKGGRNWEGFGSDPYLQGIMMAQTIEGMQEAGVQATAKHWIVNEQELNRDTMSSDVSDRVLRELYVWPFADAAHSKVAAFMCSYNKLNSTWACESEGVMQKLLKDELGHRGYIMSDWNAQHTTTGSANGGMDMTMPGSDFSGGNVLWGPQLKTAISNGQVQQSRLDDMVKRVLAAWYLMGQDKGYPATSFNSWNIGTKQISGNHGTNVRATARDGTILLKNANGALPLKKPKSIAVIGTDSIVAPRGANACVDRGCTEGVLTMGWGSGSVELPSNMVAPLDAIKTQAQKDGTTVTSSPTDNAQQGASAAQNAEIAVVCINSNAGEGYINVEGNAGDRNNLDPWHNGNELVKAVAAVNKKTVVVVHSVGPIIMEQWIENPNVVAVVWAGLPGQEPGNGVVDIMYGAASPSGKLPYTIAKKESDYGTTIASGDDKSWDLYIDYRYFDKQNITPRFEFGFGLSYTNFTYSELTVTGKPSAGPATGAVGPGGPVDLFETVATVTAKIANSGGVAGAEVPQLYLGYPASTNSPPKQLRGFSKLKLEAGASGTATFKLRRRDMSFWDEKTRKWTVATGEYTVFVGASSRDVRLTGKIVV

SEQ ID NO: 517 - DNA, 1767 bp, Unknown
  Obtained from environmental sample
atgaccacaacccgccgcactatcctgaaagccgccgccagcgccggcgcgatcgccagcaccggctggcccgccttggccgccgcacaggccgcgcaagccgccgacccgtgggcccgcgcccagcagatcatcgaccgcttcgccaagccgctcagcttcccgaacagggacttcccgatcaccgagttcggcgccaaaccctgcaagctggtcaaagcccagggcctggtcgaagtaagagtcaaaggcgaactcgaaacgccagcaccgcaagcgccggacgcctacccggcaatcaaagccgccatcgccgcagcgagcaaggccggaggagggcgcgtgctgatcccggccggcaactggtactgcaagggccctatcgtgctgctgtcgaacgtgcacgtgcaccttgccaagggcgcgcaagtctacttcagcgccaacgccaaggacttcgcccgcgacggcgactacgactgcggcgccaacggcaagctggtgctctcgcgctggcaaggcaacgattgcctgaacttctcgcccatggtctacgcgcgcgggcaaaagaatatcgccattaccggcgaagactggaccagcatcctgaacggccaggccggcgtggcgttcgaagacggcagcggcaatggctggtggggcatgaaccccgccggcgcgccgcccggcagcaccacgcaccagggcgcagccaatccgaacaacgccgaggagccaatcgccagactgcccacgcgccacgcgaactggagcgccgacgacaagtacctgccgctgctgtccgaagccggcgtgcccgccgagcgccgcgtgttcggtctggggcactacctgcggccgtcgatggtcgaattcgtcgactgcggggatgtgctgatgcagggctaccaggtcatcaacacgccgttctggattcatcacccggtcaactcacgcaacattcacttctccaaagtgcgcatggaaagcatcggcccgaattcggacggtttcgatcccgagtcctgcgacaccatcctggtggacggctgcctgttcaataccggcgacgactgcatcgccatcaaatccggcaagaaccgagactcgcaatacggcccaacgcgcaatatggtggtccagaactgcatcatgaaccgcggccacggcggcgttacgctgggcagcgaaatggcgggtggcatcgagcatatctacgcgcagaaaatcgaattccgcaacgcgttctgggaccacgacccgctgggcacggccatccgaatgaagacgaacatgaaccgcggcggctaccttcgtcatttctacgtgcgcgacgtgacgctgccgaatggcgtgcgtaccaagagcggcttctacaagacgctgccgggatctccgctggcaggcaaggtctccaccagcggcggcgctgttatcactatcgactgcgattacgcgccgaatgacgacagcgtgcgcgtgcggccgccgcaggtgtcggacgtgcatatctcgaacgtccgcgtcagcaatgtgaaaacggccgaaggctcgttctcctgctaccaggccatggtgctgctcgggcccgtggcggccagcttcaacggcgcgcctggcacggccatcctgccgatcacgaatgtcaccgtcagcgattcggacttcggcacgccgcgcaacagcgcagagccctggttcgcgttcaacgtgcagggactcaagctgcgcaacgtgcgcatcgatggcaaggagtacaacgtatga

SEQ ID NO: 518 - protein, 588 aa, Unknown
  Obtained from environmental sample
  SIGNAL (1)...(34)
  DOMAIN (110)...(555): Glycosyl hydrolases family 28
  SITE (259)...(262): N-glycosylation site. Prosite id = PS00001
  SITE (556)...(559): N-glycosylation site. Prosite id = PS00001
MTTTRRTILKAAASAGAIASTGWPALAAAQAAQAADPWARAQQIIDRFAKPLSFPNRDFPITEFGAKPCKLVKAQGLVEVRVKGELETPAPQAPDAYPAIKAAIAAASKAGGGRVLIPAGNWYCKGPIVLLSNVHVHLAKGAQVYFSANAKDFARDGDYDCGANGKLVLSRWQGNDCLNFSPMVYARGQKNIAITGEDWTSILNGQAGVAFEDGSGNGWWGMNPAGAPPGSTTHQGAANPNNAEEPIARLPTRHANWSADDKYLPLLSEAGVPAERRVFGLGHYLRPSMVEFVDCGDVLMQGYQVINTPFWIHHPVNSRNIHFSKVRMESIGPNSDGFDPESCDTILVDGCLFNTGDDCIAIKSGKNRDSQYGPTRNMVVQNCIMNRGHGGVTLGSEMAGGIEHIYAQKIEFRNAFWDHDPLGTAIRMKTNMNRGGYLRHFYVRDVTLPNGVRTKSGFYKTLPGSPLAGKVSTSGGAVITIDCDYAPNDDSVRVRPPQVSDVHISNVRVSNVKTAEGSFSCYQAMVLLGPVAASFNGAPGTAILPITNVTVSDSDFGTPRNSAEPWFAFNVQGLKLRNVRIDGKEYNV

SEQ ID NO: 519 - DNA, 2232 bp, Cochliobolus heterostrophus
  misc_feature: Cochliobolus heterostrophus ATCC 48331 DNA
gcaatcggtcctgattgtaccaatggtcccctgagtaccaatgcaatttgcgatgtcaatgcgcctcctcatgagagggcagcggctctagtcgcagctatggaaccgcaagaaaagctagataacctcgtcagtaaatccaaaggtgtgtcgagattaggtcttccagcgtataactggtggggcgaagctctacacggtgtagctggagcgccaggaatcaaattcgtcgaaccttataaaaacgctacttcgtttcctatgccaatccttatgtcggcagcttttgatgatgatctcattttcaaaattgccaatattatcgggaacgaggcccgagccttcggaaatggtggagtcgctcctatggactattggacccctgacatcaatcccgtccgcgatatacgatggggccgagccagtgaatcacccggagaggacattcgacgaataaaagggtacaccaaggctctgcttgctggcctcgaaggtgaccaagcccaaaggaagatcattgcaacatgcaaacactatgtgggttacgacatggaagcttggggaggatacgatcgacacaacttcagtgcaaagatcaccatgcaagacctcgcagagtactacatgccgccattccagcaatgtgcgcgtgactcgaaggtcgggtcattcatgtgcagctacaatgcagtcaacggtgttccaacatgcgctgacacctacgttcttcaaacaatcctgagggaccactggaactggacagatagcaataactacattactagcgattgcgaagccgttgcggatatctctgagaaccacaaatatgtcgaaacccttgcgcaaggcaccgcacttgcttttgccaagggtatggatcttagctgtgaatacagtggatcgtcagatatcccaggagcttggtcacaaggtcttctgaatctttctgttatcgacaaagcattgactcgacaatatgaaggcttagtccatgccggctactttgatggcgcgaaggcgacttacgcaaacttgagttataatgacatcaacacacccgaagcacgacagctatccttgcaagttacctctgaaggtttggtcatgctaaagaacgatcacacacttccattgcctctcacgaagggatcaaaggtggctatgataggtttctgggccaacgactcttccaaactccagggcatctacagcggtccacctccttaccggcactctccagtattcgctggtgaacaaatgggattagatatggccatagcctggggcccaatgattcagaactcaagtgtgcccgacaactggactaccaacgcgctcgacgcggccgagaagtccgactatattctctactttggtggtcaagactggacagtggcgcaagaaggctacgatcgcactacaatcagttttcctcaagtgcaaatcgaccttcttgccaaactggctaaacttggcaagccgcttgttgtcatcacgcttggtgatatgactgatcactcccctctcttgtccatggaaggcatcaactcaattatctgggcgaattggcctggccaagatggcggtccagcgatactaaacgtgatttccggtgtgcatgctcctgcaggtcgtttgccaataacggaatacccggcagattatgtcaagctctctatgcttgacatgaacttgcgaccacatgccgagagccctggccgtacttatcgctggttcaatgagtctgttcagccatttggcttcggtctacattacactacttttgaggctggttttgctagcgaagaaggtctaacctacgatatccaggaaaccttggatagctgtacacagcagtacaaggatttgtgtgaggttgcaccactggaggtcaccgtggcaaacaagggtaaccgaacatcggatttcgtcgctctcgctttcatcaagggcgaggttggacctaagccatacccactaaagactctgattacgtacgggaggctcagagatatccatgggggcgcgaagaagtcggcgtcacttccgcttacacttggagaattggccagagtggatcaatcaggcaacaccgttatctatcccggcgaatacaccctgctccttgacgagcctactcaggctgagctgaaattgactattacgggcgaggagacaattctggacaaatggccccagccgccaaacggaggcaatcggaccgtgctttga

SEQ ID NO: 520 - protein, 743 aa, Cochliobolus heterostrophus
  DOMAIN (1)...(743): Cochliobolus heterostrophus ATCC 48331 protein
  DOMAIN (47)...(297): Glycosyl hydrolase family 3 N terminal domain
  DOMAIN (367)...(594): Glycosyl hydrolase family 3 C terminal domain
  SITE (83)...(86): N-glycosylation site. Prosite id = PS00001
  SITE (255)...(258): N-glycosylation site. Prosite id = PS00001
  SITE (318)...(321): N-glycosylation site. Prosite id = PS00001
  SITE (349)...(352): N-glycosylation site. Prosite id = PS00001
  SITE (400)...(403): N-glycosylation site. Prosite id = PS00001
  SITE (440)...(443): N-glycosylation site. Prosite id = PS00001
  SITE (446)...(449): N-glycosylation site. Prosite id = PS00001
  SITE (588)...(591): N-glycosylation site. Prosite id = PS00001
  SITE (647)...(650): N-glycosylation site. Prosite id = PS00001
  SITE (750)...(753): N-glycosylation site. Prosite id = PS00001
AIGPDCTNGPLSTNAICDVNAPPHERAAALVAAMEPQEKLDNLVSKSKGVSRLGLPAYNWWGEALHGVAGAPGIKFVEPYKNATSFPMPILMSAAFDDDLIFKIANIIGNEARAFGNGGVAPMDYWTPDINPVRDIRWGRASESPGEDIRRIKGYTKALLAGLEGDQAQRKIIATCKHYVGYDMEAWGGYDRHNFSAKITMQDLAEYYMPPFQQCARDSKVGSFMCSYNAVNGVPTCADTYVLQTILRDHWNWTDSNNYITSDCEAVADISENHKYVETLAQGTALAFAKGMDLSCEYSGSSDIPGAWSQGLLNLSVIDKALTRQYEGLVHAGYFDGAKATYANLSYNDINTPEARQLSLQVTSEGLVMLKNDHTLPLPLTKGSKVAMIGFWANDSSKLQGIYSGPPPYRHSPVFAGEQMGLDMAIAWGPMIQNSSVPDNWTTNALDAAEKSDYILYFGGQDWTVAQEGYDRTTISFPQVQIDLLAKLAKLGKPLVVITLGDMTDHSPLLSMEGINSIIWANWPGQDGGPAILNVISGVHAPAGRLPITEYPADYVKLSMLDMNLRPHAESPGRTYRWFNESVQPFGFGLHYTTFEAGFASEEGLTYDIQETLDSCTQQYKDLCEVAPLEVTVANKGNRTSDFVALAFIKGEVGPKPYPLKTLITYGRLRDIHGGAKKSASLPLTLGELARVDQSGNTVIYPGEYTLLLDEPTQAELKLTITGEETILDKWPQPPNGGNRTVL

SEQ ID NO: 521 - DNA, 2610 bp, Cochliobolus heterostrophus
  misc_feature: Cochliobolus heterostrophus ATCC 48331 DNA
atgctgtggcttgcacaagcattgttggtcggccttgcccaggcatcgcccaggttccctcgtgctaccaacgacaccggcagtgattctttgaacaatgcccagagcccgccattctacccaagtccttgggtagatcccaccaccaaggactgggcggctgcctatgaaaaagcaaaggcttttgttagccaattgactcttattgagaaggtcaacctcaccaccggcactggatggcagagcgaccactgcgttggtaacgtgggcgctattcctcgccttggctttgatcccctctgcctccaggacagccctctcggcatccgtttcgcagactacgtttctgctttcccagcaggtggcaccattgctgcatcatgggaccgctatgagttttacacccgcggtaacgagatgggtaaggagcaccgaaggaagggagtcgacgttcagcttggtcctgccattggacctcttggtcgccaccccaagggcggtcgtaactgggaaggcttcagtcctgatcctgtactttccggtgtggccgtgagcgaaacagtccgcggtatccaggatgctggtgtcattgcctgcactaagcacttccttctgaacgagcaagaacatttccgtcagcccggcagtttcggagatatcccctttgtcgatgccatcagctccaataccgatgacacgactctacacgagctctacctgtggccctttgccgacgccgtccgcgctggtactggtgccatcatgtgctcttacaacaaggccaacaactcgcaactctgccaaaactcgcaccttcaaaactatattctcaagggcgagcttggcttccagggtttcattgtatctgactgggatgcacagcactcgggcgttgcgtcggcttatgctggattggacatgactatgcctggtgatactggattcaacactggactgtccttctggggcgctaacatgaccgtctccattctcaacggcaccattccccagtggcgtctcgacgatgcggccatccgtatcatgaccgcatactactttgtcggccttgatgagtctatccctgtcaactttgacagctggcaaactagcacgtacggattcgagcattttttcggaaagaagggcttcggtctgatcaacaagcacattgacgttcgcgaggagcacttccgctccatccgccgctctgctgccaagtcaaccgttctcctcaagaactctggcgtccttcccctctctggaaaggagaagtggactgctgtatttggagaagatgctggcgaaaacccgctgggccccaacggatgcgctgaccgcggctgcgactctggcaccttggccatgggctggggttcgggaactgcagacttcccttacctcgtcactcctctcgaagccatcaagcgtgaggttggcgagaatggcggcgtgatcacttcggtcacagacaactacgccacttcgcagatccagaccatggccagcagggccagccactcgattgtcttcgtcaatgccgactctggtgaaggttacatcactgttgataacaacatgggtgaccgcaacaacatgactgtgtggggcaatggtgatgtgcttgtcaagaatatctctgctctgtgcaacaacacgattgtggttatccactctgtcggcccagtcattattgacgcctggaaggccaacgacaacgtgactgccattctctgggctggtcttcctggccaggagtctggtaactcgattgctgacattctatacggacaccacaaccctggtggcaagctccccttcaccattggcagctcttcagaggagtatggccctgatgtcatctacgagcccacgaacggcatcctcagccctcaggccaactttgaagagggcgtcttcattgactaccgcgcgtttgacaaggcgggcattgagcccacgtacgaatttggctttggtctttcgtacacgacttttgaatactcggacctcaaggtcactgcgcagtctgccgaggcttacaagcctttcaccggccagacttcggctgcccctacattcggaaacttcagcaagaaccccgaggactaccagtaccctcccggccttgtttaccccgacacgttcatctacccctacctcaactcgactgacctcaagacggcatctcaggatcccgagtacggcctcaacgttacctggcccaagggctctaccgatggctcgcctcagacccgcattgcggctggtggtgcgcccggcggtaacccccagctctgggacgttttgttcaaggtcgaggccacgatcaccaacactggtcacgttgctggtgacgaggtggcccaggcgtacatctcgcttggtggccccaacgaccccaaggtgctactccgtgactttgaccgcttgaccatcaagcctggtgagagcgctgttttcacagccaacatcacccgccgtgatgtcagcaactgggacactgtcagccagaactgggtcattaccgagtaccccaagacgatccacgttggtgccagttcgaggaaccttcctctttctgccccactggacactagcagctttagataa

SEQ ID NO: 522 - protein, 869 aa, Cochliobolus heterostrophus
  DOMAIN (1)...(869): Cochliobolus heterostrophus ATCC 48331 protein
  DOMAIN (89)...(310): Glycosyl hydrolase family 3 N terminal domain
  DOMAIN (408)...(642): Glycosyl hydrolase family 3 C terminal domain
  SITE (24)...(27): N-glycosylation site. Prosite id = PS00001
  SITE (74)...(77): N-glycosylation site. Prosite id = PS00001
  SITE (266)...(269): N-glycosylation site. Prosite id = PS00001
  SITE (280)...(297): Glycosyl hydrolases family 3 active site. Prosite id = PS00775
  SITE (337)...(340): N-glycosylation site. Prosite id = PS00001
  SITE (539)...(542): N-glycosylation site. Prosite id = PS00001
  SITE (552)...(555): N-glycosylation site. Prosite id = PS00001
  SITE (558)...(561): N-glycosylation site. Prosite id = PS00001
  SITE (580)...(583): N-glycosylation site. Prosite id = PS00001
  SITE (705)...(708): N-glycosylation site. Prosite id = PS00001
  SITE (732)...(735): N-glycosylation site. Prosite id = PS00001
  SITE (748)...(751): N-glycosylation site. Prosite id = PS00001
  SITE (835)...(838): N-glycosylation site. Prosite id = PS00001
MLWLAQALLVGLAQASPRFPRATNDTGSDSLNNAQSPPFYPSPWVDPTTKDWAAAYEKAKAFVSQLTLIEKVNLTTGTGWQSDHCVGNVGAIPRLGFDPLCLQDSPLGIRFADYVSAFPAGGTIAASWDRYEFYTRGNEMGKEHRRKGVDVQLGPAIGPLGRHPKGGRNWEGFSPDPVLSGVAVSETVRGIQDAGVIACTKHFLLNEQEHFRQPGSFGDIPFVDAISSNTDDTTLHELYLWPFADAVRAGTGAIMCSYNKANNSQLCQNSHLQNYILKGELGFQGFIVSDWDAQHSGVASAYAGLDMTMPGDTGFNTGLSFWGANMTVSILNGTIPQWRLDDAAIRIMTAYYFVGLDESIPVNFDSWQTSTYGFEHFFGKKGFGLINKHIDVREEHFRSIRRSAAKSTVLLKNSGVLPLSGKEKWTAVFGEDAGENPLGPNGCADRGCDSGTLAMGWGSGTADFPYLVTPLEAIKREVGENGGVITSVTDNYATSQIQTMASRASHSIVFVNADSGEGYITVDNNMGDRNNMTVWGNGDVLVKNISALCNNTIVVIHSVGPVIIDAWKANDNVTAILWAGLPGQESGNSIADILYGHHNPGGKLPFTIGSSSEEYGPDVIYEPTNGILSPQANFEEGVFIDYRAFDKAGIEPTYEFGFGLSYTTFEYSDLKVTAQSAEAYKPFTGQTSAAPTFGNFSKNPEDYQYPPGLVYPDTFIYPYLNSTDLKTASQDPEYGLNVTWPKGSTDGSPQTRIAAGGAPGGNPQLWDVLFKVEATITNTGHVAGDEVAQAYISLGGPNDPKVLLRDFDRLTIKPGESAVFTANITRRDVSNWDTVSQNWVITEYPKTIHVGASSRNLPLSAPLDTSSFR

SEQ ID NO: 523 - DNA, 642 bp, Unknown
  Obtained from environmental sample
atgtttatgttaagtaagaaaattttgatggtgttattaacaatttcaatgagttttattagcttatttacagtaaccgcgtatgcagcttcgacagactactggcaaaattggactgatggtggtgggacagtaaatgctaccaatggatctgatggcaattacagtgtttcatggacaaattgcgggaattttgttgtcggtaaaggctggactaccggatcagcatctagggtaataaactacaatgccggcgccttttcgccgtccggtaatgggtatttggctctctatgggtggacgagaaactcactcatagaatattacgttgttgatagctggggtacttatagacctactggaacttataagggcactgtgactagtgatggggggacatatgacatatatacgactacacgaactaacgcaccttccattgacggaactgcaacttttacccagttctggagtgtaaggcagtcgaagagaccgaccggtaccaacaacaccattacttttagcaaccacgttaacgcatggaagagtaaagggatgaatttggggagtagttggtcttatcaggtattagcgacagagggatatcaaagtagtgggtactctaatgtaacggtctggtaa

SEQ ID NO: 524 - protein, 213 aa, Unknown
  Obtained from environmental sample
  SIGNAL (1)...(29)
  DOMAIN (29)...(212): Glycosyl hydrolases family 11
  SITE (37)...(40): N-glycosylation site. Prosite id = PS00001
  SITE (46)...(49): N-glycosylation site. Prosite id = PS00001
  SITE (54)...(57): N-glycosylation site. Prosite id = PS00001
  SITE (105)...(115): Glycosyl hydrolases family 11 active site signature 1. Prosite id = PS00776
  SITE (171)...(174): N-glycosylation site. Prosite id = PS00001
  SITE (200)...(211): Glycosyl hydrolases family 11 active site signature 2. Prosite id = PS00777
  SITE (212)...(215): N-glycosylation site. Prosite id = PS00001
MFMLSKKILMVLLTISMSFISLFTVTAYAASTDYWQNWTDGGGTVNATNGSDGNYSVSWTNCGNFVVGKGWTTGSASRVINYNAGAFSPSGNGYLALYGWTRNSLIEYYVVDSWGTYRPTGTYKGTVTSDGGTYDIYTTTRTNAPSIDGTATFTQFWSVRQSKRPTGTNNTITFSNHVNAWKSKGMNLGSSWSYQVLATEGYQSSGYSNVTVW

What is claimed is:

1. An isolated, synthetic, or recombinant polypeptide comprising the amino acid sequence of SEQ ID NO: 54 and having cellobiohydrolase activity, said polypeptide encoded by the polynucleotide sequence of SEQ ID NO: 53.

2. A composition comprising the polypeptide of claim 1.

3. A food, a feed, a nutritional supplement, or a beverage comprising the polypeptide of claim 1.

4. A cellulose- or cellulose derivative-composition comprising the polypeptide of claim 1.

5. A wood, wood pulp, wood product, recycled paper, paper waste, paper, paper pulp or paper product comprising the polypeptide of claim 1.

6. An enzyme ensemble, or "cocktail", for depolymerization of cellulosic and hemicellulosic polymers to metabolizeable carbon moieties comprising the polypeptide of claim 1.

* * * * *